US010017568B2

(12) United States Patent
Rommelaere et al.

(10) Patent No.: US 10,017,568 B2
(45) Date of Patent: Jul. 10, 2018

(54) POLYPEPTIDES THAT BIND TO IL-17A, IL-17F AND/OR IL17-A/F AND METHOD OF TREATMENT USING SAME

(75) Inventors: Heidi Rommelaere, Ghent (BE); Joost Alexander Kolkman, Sint-Martens-Latem (BE); Michael John Scott Saunders, Brussels (BE); Ann Union, Aalter (BE); Yolande Chvatchko, Confignon (CH); Amanda E. I. Proudfoot, Chens sur Leman (FR); Alain Vicari, Neydens (FR); Denis Bruniquel, Thoiry (FR); Laurent Chevalet, Cuvat (FR); Olivier Leger, Saint-Sixt (FR)

(73) Assignee: Merck Patent GmbH, Darmstadt (DE)

( * ) Notice: Subject to any disclaimer, the term of this patent is extended or adjusted under 35 U.S.C. 154(b) by 0 days.

(21) Appl. No.: 14/115,549

(22) PCT Filed: May 4, 2012

(86) PCT No.: PCT/EP2012/058313

§ 371 (c)(1),
(2), (4) Date: Jun. 16, 2014

(87) PCT Pub. No.: WO2012/156219

PCT Pub. Date: Nov. 22, 2012

(65) Prior Publication Data

US 2014/0314743 A1 Oct. 23, 2014

Related U.S. Application Data

(60) Provisional application No. 61/482,802, filed on May 5, 2011.

(51) Int. Cl.

| | |
|---|---|
| ***A61K 39/395*** | (2006.01) |
| ***C07K 16/24*** | (2006.01) |
| *A61K 39/00* | (2006.01) |

(52) U.S. Cl.

CPC ...... *C07K 16/244* (2013.01); *A61K 2039/505* (2013.01); *C07K 2317/22* (2013.01); *C07K 2317/24* (2013.01); *C07K 2317/31* (2013.01); *C07K 2317/33* (2013.01); *C07K 2317/34* (2013.01); *C07K 2317/569* (2013.01); *C07K 2317/64* (2013.01); *C07K 2317/76* (2013.01); *C07K 2317/92* (2013.01); *C07K 2317/94* (2013.01); *C07K 2319/00* (2013.01)

(58) Field of Classification Search

None

See application file for complete search history.

(56) References Cited

U.S. PATENT DOCUMENTS

| | | | |
|---|---|---|---|
| 6,043,344 | A | 3/2000 | Jacobs et al. |
| 6,274,711 | B1 | 8/2001 | Golstein et al. |
| 6,486,303 | B1 | 11/2002 | Moyle |
| 6,902,735 | B1 | 6/2005 | Jacobs et al. |
| 8,609,093 | B2 | 12/2013 | Masternak et al. |
| 8,715,669 | B2 | 5/2014 | Masternak et al. |
| 2002/0177188 | A1 | 11/2002 | Chen et al. |
| 2006/0270003 | A1 | 11/2006 | Arnott et al. |
| 2007/0065440 | A1 | 3/2007 | Tomlinson et al. |
| 2007/0160576 | A1 | 7/2007 | Arnott et al. |
| 2008/0095775 | A1 | 4/2008 | Lewis et al. |
| 2008/0124345 | A1 | 5/2008 | Rothe et al. |
| 2008/0241138 | A1 | 10/2008 | Levin et al. |
| 2008/0241166 | A1 | 10/2008 | Tomlinson et al. |
| 2009/0148447 | A1 | 6/2009 | Ledbetter et al. |
| 2009/0252681 | A1 | 10/2009 | Laeremans et al. |
| 2010/0080812 | A1 | 4/2010 | Auer et al. |
| 2010/0266609 | A1 | 10/2010 | Adams et al. |

FOREIGN PATENT DOCUMENTS

| | | | |
|---|---|---|---|
| CL | 1213-2015 | A | 7/2015 |
| CN | 101674846 | A | 3/2010 |
| EP | 0 451 216 | B1 | 10/1991 |
| EP | 1 641 822 | B1 | 5/2013 |
| JP | 2008-520224 | A | 6/2008 |
| JP | 2009-511032 | A | 3/2009 |
| JP | 2009-521913 | A | 6/2009 |
| JP | 2010-506580 | A | 3/2010 |
| WO | WO-95/18826 | A2 | 7/1995 |
| WO | WO-97/04097 | A2 | 2/1997 |
| WO | WO-00/20593 | A1 | 4/2000 |
| WO | WO-00/69463 | A1 | 11/2000 |
| WO | WO-01/46420 | A2 | 6/2001 |
| WO | WO-02/064739 | A2 | 8/2002 |
| WO | WO-2006/013107 | A1 | 2/2006 |
| WO | WO-2006/054059 | A1 | 5/2006 |

(Continued)

OTHER PUBLICATIONS

Ghahroudi, M. Arbabi et al., "Selection and Identification of Single Domain Antibody Fragments from Camel Heavy-Chain Antibodies," FEBS Letters, vol. 414, No. 3, Sep. 15, 1997, pp. 521-526, XP004261105.

Holt, Lucy J. et al., "Domain Antibodies: Proteins for Therapy," Trends in Biotechnology, vol. 21, No. 11, Nov. 1, 2003, pp. 484-490, XP004467495.

Inernational Search Report and Written Opinion received in Application No. PCT/EP2012/058313, dated Oct. 29, 2012.

Vincke, Cecile et al., "General Stategy to Humanize a Camelid Single-domain Antibody and Identification of a Universal Humanized Nanobody Scaffold," The Journal of Biological Chemistry, vol. 284, No. 5, Jan. 30, 2009, pp. 3273-3284, XP009124408.

First Examination Report issued in co-pending New Zealand Application No. 616761 dated Sep. 5, 2014.

Office Action and Search Report issued in co-pending Chinese Application No. 201280033175.1 dated Mar. 9, 2015, with partial English translation.

(Continued)

*Primary Examiner* — Dong Jiang

(74) *Attorney, Agent, or Firm* — Gilberto M. Villacorta; Peng Sun; Foley & Lardner LLP

(57) ABSTRACT

The present disclosure relates to amino acid sequences that are directed against (as defined herein) any of IL-17A, IL-17F and/or IL-17A/F including combinations thereof, as well as to compounds or constructs, and in particular proteins and polypeptides, that comprise or essentially consist of one or more such amino acid sequences.

13 Claims, 44 Drawing Sheets

(56) References Cited

FOREIGN PATENT DOCUMENTS

Figure 1:
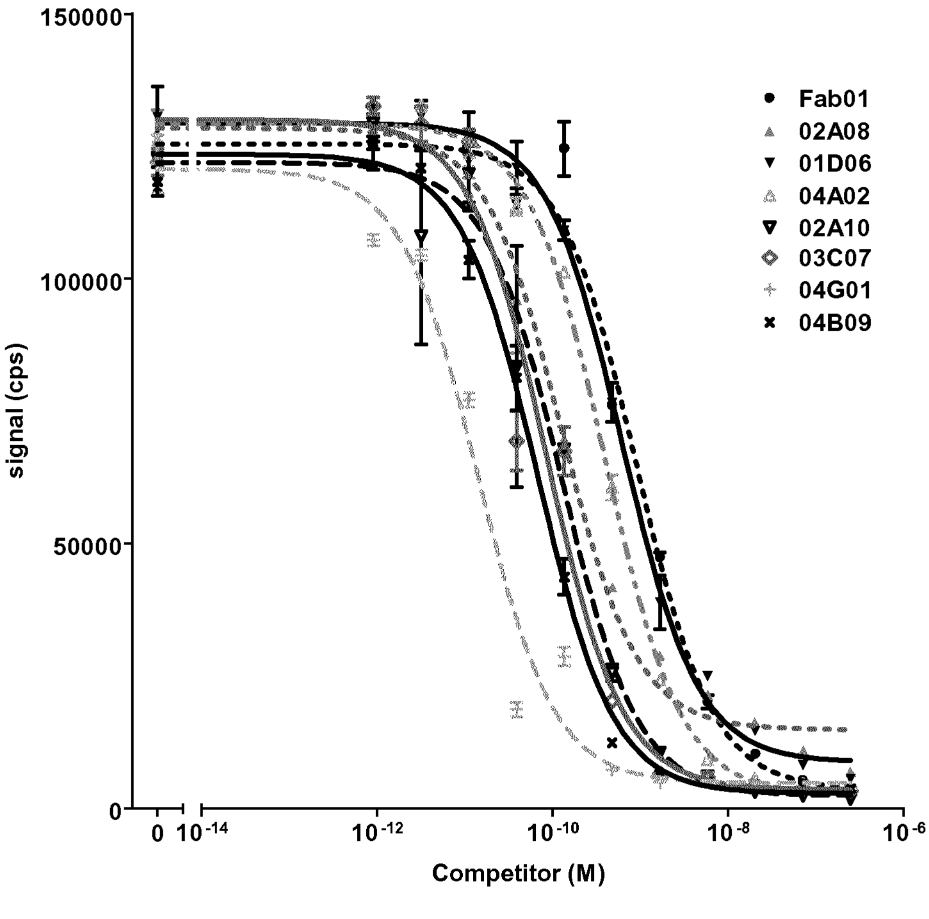

| WO | WO-2006/088833 A2 | 8/2006 |
|---|---|---|
| WO | WO-2007/149032 A1 | 12/2007 |
| WO | WO-2008/001063 A1 | 1/2008 |
| WO | WO-2008/047134 A2 | 4/2008 |
| WO | WO-2008/054603 A2 | 5/2008 |
| WO | WO-2008/067223 A2 | 6/2008 |
| WO | WO-2008/100624 A2 | 8/2008 |
| WO | WO-2009/082624 A2 | 7/2009 |
| WO | WO-2009/136286 A2 | 11/2009 |
| WO | WO-2010/025400 A2 | 3/2010 |
| WO | WO-2010/034443 A1 | 4/2010 |
| WO | WO-2010/102251 A2 | 9/2010 |
| WO | WO-2010/128407 A2 | 11/2010 |
| WO | WO-2011/053763 A2 | 5/2011 |
| WO | WO-2011/088120 A9 | 7/2011 |
| WO | WO-2012/045848 A1 | 4/2012 |
| WO | WO-2012/059598 A1 | 5/2012 |
| WO | WO-2012/095662 A1 | 7/2012 |
| WO | WO-2013/063110 A1 | 5/2013 |
| WO | WO-2013/150043 A1 | 10/2013 |
| WO | WO-2013/158577 A1 | 10/2013 |
| WO | WO-2014/122613 A1 | 8/2014 |

OTHER PUBLICATIONS

Office Action issued in corresponding Eurasian application No. 201391632 dated Sep. 16, 2015 with English translation.
Ely et al "Structural basis of receptor sharing by interleukin 17 cytokines" Nature Immunology, vol. 10, pp. 1245-1251.
Further Examination Report issued in corresponding New Zealand Application No. 616761 dated Nov. 18, 2015.
Gaffen "Structure and signalling in the IL-17 receptor family" Nature Review Immunology, vol. 9, pp. 556-567.
NZ Tribunal Pantext Pty Ltd (1996) NZIPOPAT 6 (Jun. 13, 1996).
NZ Tribunal Song, Jiasheng (2015) NZIPOPAT 20 (May 27, 2015).
Chinese Office Action with English translation issued in co-pending Chinese Patent Application No. 201280033175.1 dated Sep. 16, 2015.
Further Examination Report issued in co-pending New Zealand Application No. 616761 dated Aug. 7, 2015.
Chinese Office Action issued in co-pending Chinese Application No. 201280033175.1, dated Jan. 8, 2016 (with English translation).
EBI Dbfetch Database Entry, DI579107, Feb. 21, 2008, available at http://www.ebi.ac.uk/Tools/dbfetch/dbfetch?db=KPOP;id=DI579107;format=default.
EBI Dbfetch Database Entry, DI572183, Feb. 21, 2008, available at http://www.ebi.ac.uk/Tools/dbfetch/dbfetch?db=KPOP;id=DI572183;format=default.
Notification of Reasons for Refusal, dated May 12, 2016 in corresponding Japanese application No. 2014-508842.
Achour et al., "Tetrameric and Homodimeric Camelid IgGs Originate from the Same IgH Locus," The Journal of Immunology, vol. 181, No. 3, pp. 2001-2009.
English Translation of Chinese Office Action corresponding to Application No. 201180021948, dated Jun. 17, 2015, 7 pages.
Examination Report dated May 18, 2016 in related Chilean appl. 3090-2013.
First Examination Report dated Sep. 5, 2016 in Indonesian Appl. W00201204770.
Goldsby, et al. "Generation of B-Cell and T-Cell Responses" IMMUNOLOGY, Antibodies Structure and Function, Chapter 4, 2003, 5th Edition, pp. 82-84.
Holz, Josefin-Beate. "Developing Nanobodies: From Bench to Bedside". Jun. 24, 2008, pp. 1-37.
International Search Report for PCT/EP2011/058295—dated Aug. 11, 2011.
Jiang, et al. "A Novel Peptide Isolated from a Phage Display Peptide Library with Trastuzumab Can Mimic Antigen Epitope of HER-2", The Journal of Biological Chemistry, Issue of Feb. 11, 2005, vol. 280, No. 6, pp. 4656-4662.

McCarthy, et al. "Altering the fine specificity of an anti-Legionella single chain antibody by a single amino acid insertion", Journal of Immunological Methods, 2001, vol. 251, pp. 137-149.
Notification of Reasons for Refusal issued in co-pending Japanese Application No. 2013-510642 dated Jun. 15, 2015, with partial English translation.
Office Action issued in European Patent Application No. 11720539.3 dated Feb. 26, 2016.
Rudikoff, et al. "Single amino acid substitution altering antigen-binding specificity", Proc. Natl. Acad. Sci., Mar. 1982, vol. 79, pp. 1979-1983.
Scamurra et al., "Mucosal Plasma Cell Repertoire During HIV-1 Infection," The Journal of Immunology, vol. 169, 2002, pp. 4008-4016.
Schoeberl Birgit et al: "An ErbB3 antibody, MM-121, is active in cancers with ligand-dependent activation", Cancer Research / American Association for Cancer Research, AACR, Philadelphia, PA, vol. 70, No. 6, Mar. 15, 2010 (Mar. 15, 2010), pp. 2485-2494, XP002581703.
Stancovski, et al. "Mechanistic aspects of the opposing effects of monoclonal antibodies to the ERBB2 receptor on tumor growth", Proc. Natl. Acad. Sci., Oct. 1991, vol. 88, pp. 8691-8695.
Tijink Bernard M et al: "Improved tumor targeting of anti-epidermal growth factor receptor Nanobodies through albumin binding: taking advantage of modular Nanobody technology", Molecular Cancer Therapeutics, American Association of Cancer Research, US, vol. 7, No. 8, Aug. 1, 2008 (Aug. 1, 2008), pp. 2288-2297, XP009124410.
Treder M et al: "309 POSTER Fully human anti-HER3 mAb U3-1287 (AMG 888) demonstrates unique in vitro and in vivo activities versus other HER family inhibitors in NSCLC models", European Joural of Cancer. Supplement, Pergamon, Oxford, GB, vol. 6, No. 12, Oct. 1, 2008 (Oct. 1, 2008), p. 99, XP025534373.
Non-Final Office Action dated May 20, 2014 in co-pending U.S. Appl. No. 13/698,992 (32 pgs.).
Watkins et al., "Single-chain antibody fragments derived from a human synthetic phage-display library bind thrombospondin and inhibit sickle cell adhesion," Blood, vol. 102, No. 2, Jul. 15, 2003, pp. 718-724.
Woolven et al., "The structure of the llama heavy chain constant genes reveals a mechanism for heavy-chain antibody formation," Immunogenetics, vol. 50, 1999, pp. 98-101.
Di Cosimo, S. et al. "Management of breast cancer with targeted agents: importance of heterogenicity". Nat. Rev. Clin. Oncol., vol. 7, 2010, pp. 139-147.
Aarvak, T. et al. "IL-17 is Produced by Some Proinflammatory Th1/Th0 Cells But Not by Th2 Cells." J. Immunol., vol. 162, 1999, pp. 1246-1251.
Aggarwal et al., "Interleukin-23 Promotes a Distinct CD4 T Cell Activation State Characterized by the Production of Interleukin-17*," Journal of Biological Chemistry, 2003, 278(3): 1910-1914.
Aggarwal, S. et al. "IL-17: prototype member of an emerging cytokine family." Journal of Leukocyte Biology, vol. 71, 2002, pp. 1-8.
Brizzard, B. et al. "Epitope Tagging of Recombinant Proteins." in Curr Protoc Neurosci., Chapter 5, Unit 5.8, Wiley & Sons, 1997, 10 pgs.
Burchill, M. et al. "Inhibition of Interleukin-17 Prevents the Development of Arthritis in Vaccinated Mice Challenged with Borrelia burgdorferi." Infection and Immunity, vol. 71, No. 6, 2003, pp. 3437-3442.
Carrano, A.V. et al. "Measurement and purification of human chromosomes by flow cytometry and sorting." Proc. Natl. Acad. Sci. USA, vol. 76, No. 3, 1979, pp. 1382-1384.
Priority Document received at International Bureau dated Aug. 23, 2004 in PCT/US04/17581.
Priority Document received at International Bureau dated Aug. 27, 2004 in PCT/US04/17581.
Chabaud, M. et al. "Human Interleukin-17 A T Cell-Derived Proinflammatory Cytokine Produced by the Rheumatoid Synovium." Arthritis & Rheumatism, vol. 42, No. 5, 1999, pp. 963-970.
Chabaud, M. et al. "Enhancing Effect of IL-17 on IL-1-Induced IL-6 and Leukemia Inhibitory Factor Production by Rheumatoid Arthri-

(56) References Cited

OTHER PUBLICATIONS tis Synoviocytes and Its Regulation by Th2 Cytokines." J. Immunol., vol. 161, 1998, pp. 409-414.
Chabaud, M. et al. "IL-17 derived from juxta-articular bone and synovium contributes to joint degradation in rheumatoid arthritis." Arthritis Research, vol. 3, 2001, pp. 168-177.
Chang, S. et al. "A novel heterodimeric cytokine consisting of IL-17 and IL-17F regulates inflammatory responses." Cell Research, vol. 17, 2007, pp. 435-440.
De Jager, W. et al. "Simultaneous Detection of 15 Human Cytokines in a Single Sample of Stimulated Peripheral Blood Mononuclear Cells." Clinical and Diagnostic Laboratory Immunology, vol. 10, No. 1, 2003, pp. 133-139.
Declaration of Philip Hass dated Feb. 27, 2015, submitted in Opposition proceedings to EP1641822B1.
Declaration of R. Grenningloh and J. DeMartino filed in opposition to EP1641822B1: Experimental Test Report: MAB317 Binding and Neutralization, dated Feb. 12, 2014.
Declaration of Sarah Hymowitz, PhD dated Feb. 27, 2015, submitted in Opposition proceedings to EP1641822B1.
Declaration of Seon Hee Chang, PhD dated Aug. 11, 2016, submitted in Opposition proceedings to EP1641822B1.
Declaration of Wenjun Ouyang dated Sep. 9, 2009 submitted in U.S. Appl. No. 11/606,192.
Declaration of Wenjun Ouyang, PhD dated Feb. 27, 2015, submitted in Opposition proceedings to EP1641822B1.
Dendritics, Product Sheet for Monoclonal Anti-human IL-17A, Product Reference: DDX0330-DDX0339, retrieved Dec. 19, 2017 from www.dendritics.net, 1 pg.
Dumont, F. "IL-17 cytokine/receptor families: emerging targets for the modulation of inflammatory responses." Expert Opin. Ther. Patents, vol. 13, No. 3, 2003, pp. 287-303.
Email correspondence from AACR dated Jul. 7, 2016 regarding author agreement policy (3 pgs.).
English-Language Machine Translation of JP2000186046 prepared Apr. 10, 2015.
English-language version of Official Gazette publication of JP2000-186046A dated Jul. 4, 2000.
EPO Form 1002 Designation of Inventor dated Sep. 20, 2010 in EP2277908 (1 pg.).
Excerpt from AACR regulations regarding policy concerning availability of materials, 2000 (1 pg.).
Experimental Report of Darko Skegro dated Aug. 10, 2016 submitted in Opposition to EP1641822B1.
Experimental Report of Max Woisetschlager dated Aug. 11, 2016, submitted in Opposition to EP1641822B1.
Ferretti, S. et al. "IL-17, Produced by Lymphocytes and Neutrophils, Is Necessary for Lipopolysaccharide-Induced Airway Neutrophilia: IL-15 as a Possible Trigger." The Journal of Immunology, vol. 170, 2003, pp. 2106-2112.
Fossiez, F. et al. "T Cell Interleukin-17 Induces Stromal Cells to Produce Proinflammatory and Hematopoietic Cytokines." J. Exp. Med., vol. 183, 1996, pp. 2593-2603.
Fujino, S. et al. "Increased expression of interleukin 17 in inflammatory bowel disease." Gut, vol. 52, 2003, pp. 65-70.
Gerstner, R. B. et al. "Sequence Plasticity in the Antigen-binding Site of a Therapeutic Anti-HER2 Antibody." J. Mol. Biol., vol. 321, 2002, pp. 851-862.
Hellings, P. et al. "Interleukin-17 Orchestrates the Granulocyte Influx into Airways after Allergen Inhalation in a Mouse Model of Allergic Asthma." Am. J. Respir. Cell Mol. Biol., vol. 28, 2003, pp. 42-50.
Honorati, M.C. et al. "IL-17 enhances the susceptibility of U-2 OS osteosarcoma cells to NK cell lysis." Clin Exp Immunol, vol. 133, 2003, pp. 344-349.
Hornbeck, P. "Assays for Antibody Production." in Curr. Protoc. Immuno. Chapter 1, Unit 2.1, Wiley & Sons, 1991, 22 pgs.
Hurst, S. et al. "New IL-17 Family Members Promote Th1 or Th2 Responses in the Lung: In Vivo Function of the Novel Cytokine IL-25." The Journal of Immunology, vol. 169, 2002, pp. 443-453.
Hymowitz, S.G. et al. "IL-17s adopt a cystine knot fold: structure and activity of a novel cytokine, IL-17F, and implications for receptor binding." The EMBO Journal, vol. 20, No. 19, 2001, pp. 5332-5341.
Janeway, C. et al. Immunologie, vol. 5, 2002, pp. 107-112.
Kawaguchi, M. et al. "IL-17 Cytokine Family." J Allergy Clin Immunol, vol. 114, No. 6, 2004, pp. 1265-1273.
Lippens et al. "Therapeutic Efficacy of IL-17A versus IL-17F neutralization in mCIA, a mouse model of rheumatoid arthritis." Poster for NovImmune, submitted Feb. 14, 2014 in Opposition to EP1641822B1.
Lonberg, N. et al. "Human Antibodies from Transgenic Mice." Intern. Rev. Immunol. vol. 13, 1995, pp. 65-93.
McCafferty, J. et al. "Phage antibodies: filamentous phage displaying antibody variable domains." Nature, vol. 348, 1990, pp. 552-554.
McDonald, N. et al. "A Structural Superfamily of Growth Factors Containing a Cystine Knot Motif." Cell, vol. 73, 1993, pp. 421-424.
Miranda-Carus, M. et al. "IL-15 and the Initiation of Cell Contact-Dependent Synovial Fibroblast-T Lymphocyte Cross-Talk in Rheumatoid Arthritis: Effect of Methotrexate." The Journal of Immunology, vol. 173, 2004, pp. 1463-1476.
Miyamoto, M. et al. "Endogenous IL-17 as a Mediator of Neutrophil Recruitment Caused by Endotoxin Exposure in Mouse Airways." The Journal of Immunology, vol. 170, 2003, pp. 4665-4672.
Moseley, T.A. et al. "Interleukin-17 family and IL-17 receptors." Cytokine & Growth Factor Reviews, vol. 14, 2003, pp. 155-174.
Nakae, S. et al. "Antigen-Specific T Cell Sensitization Is Impaired in IL-17-Deficient Mice, Causing Suppression of Allergic Cellular and Humoral Responses." Immunity, vol. 17, 2002, 375-387.
NCBI Basic Local Alignment Search Tool for IL-17A vs. AL355513.11, retrieved Dec. 20, 2013, 8 pgs.
NCBI Basic Local Alignment Search Tool for IL-17F vs. AL355513.11, retrieved Dec. 19, 2013, 14 pgs.
Nelson, P.N. et al. "Monoclonal Antibodies." J Clin Pathol: Mol Pathol, vol. 53, 2000, pp. 111-117.
Notice of Entitlement dated Dec. 19, 2011 in Australian Patent Appl. No. 2008229758 (1 pg.).
Numasaki, M. et al. "Interleukin-17 promotes angiogenesis and tumor growth." Blood, vol. 101, No. 7, pp. 2620-2627.
Office Action dated Nov. 13, 2017 in related Eurasian Appl. No. 201391632/28 with English-language translation.
Office Action dated Oct. 2, 2008 in U.S. Appl. No. 11/606,192.
Ogawa, Y. et al. "Purification and Characterization of Transforming Growth Factor-B2.3 and -B1.2 Heterodimers from Bovine Bone." The Journal of Biological Chemistry, vol. 267, No. 4, 1992, pp. 2325-2328.
Oppmann et al., Novel p19 Protein Engages IL-12p40 to Form a Cytokine, IL-23, with Biological Activities Similar as Well as Distinct from IL-12,$201D Immunity, 2000, 13:715-725.
Page, G. et al. "Plasma Cell-Like Morphology of Th1-Cytokine-Producing Cells Associated with the Loss of CD3 Expression." Am J of Path, vol. 164, No. 2, 2004, pp. 409-417.
Patent Assignment Abstract of Title for U.S. Appl. No. 11/606,192 (1 pg.).
Pham, V. et al. "De novo proteomic sequencing of a monoclonal antibody raised against OX40 ligand." Analytical Biochemistry, vol. 352, 2006, pp. 77-86.
R&D Systems Catalog, 2003, pp. 289 and 401.
R&D Systems Inc, Product Information Sheet for Monoclonal Anti-human IL-17 antibody MAB317, 1998, 2 pgs.
R&D Systems, Catalog entry No. AF-317-NA for Human IL-17 Antibody, revised Aug. 27, 2012, 2 pg.
R&D Systems, Catalog entry No. MAB317 for Human IL-17 Antibody, revised Aug. 27, 2012, 1 pg.
R&D Systems, confirmation of sales data for MAB317, Jan. 22, 2014, 1 pg.
R&D Systems, Minireview of Activin/Inhibin dated Jan. 1, 1998, 7 pgs.
R&D Systems, Online Product Search for IL-17 Antibodies, retrieved Feb. 3, 2014 from www.rndsystems.com, 1 pg.
RCE filed Nov. 7, 2012 in U.S. Appl. No. 13/039,201.
Response filed Jan. 22, 2009 in U.S. Appl. No. 11/606,192.

(56) References Cited

OTHER PUBLICATIONS

Response filed May 3, 2010 in U.S. Appl. No. 11/606,192.
Response to Final Office Action dated Nov. 3, 2009 in U.S. Appl. No. 11/606,192.
Sabat, R. et al. "IL-22 and IL-17: An Overview." IL-17, IL-22 and their producing cells: Role in inflammation and autoimmunity (EDS). V. Quesniaux et al., 2013, Springer Basel, pp. 11-35.
Starnes, T. et al. "Cutting Edge: IL-17F, a Novel Cytokine Selectively Expressed in Activated T Cells and Monocytes, Regulates Angiogenesis and Endothelial Cell Cytokine Production." J. Immunol. vol. 167, 2001, pp. 4137-4140.
Supplemental data filed by Opponent on Feb. 14, 2014 in Opposition to EP1641822B1.
Suzuki, M. et al. "The role of p38 mitogen-activated protein kinase in IL-6 and IL-8 production from the TNF-a or IL-1B-stimulated rheumatoid synovial fibroblasts." FEBS Letters, vol. 465, 2000, 23-27.
Takei, Y. et al. "51,31-Inverted Thymidine-modified Antisense Oligodeoxynucleotide Targeting Midkine." The Journal of Biological Chemistry, vol. 277, No. 26, 2002, pp. 23800-23806.
Tan, P. et al. "'Superhumanized' Antibodies: Reduction of Immunogenic Potential by Complementarity-Determining Region Grafting with Human Germline Sequences: Application to an Anti-CD28." The Journal of Immunology, vol. 169, 2002, pp. 1119-1125.
Tartour, E. et al. "Interleukin 17, a T-cell-derived Cytokine, Promotes Tumorigenicity of Human Cervical Tumors in Nude Mice." Cancer Research, vol. 59, 1999, pp. 3698-3704.
Thiele, K. et al. "Cell-cell contact of human T cells with fibroblasts changes lymphocytic mRNA expression: increased mRNA expression of interleukin-17 and interleukin-17 receptor." Eur. Cytokine Netw., vol. 11, No. 1, 2000, pp. 53-58.
Umland, S. et al. "The inhibitory effects of topically active glucocorticoids on IL-4, IL-5, and interferon-y production by cultured primary CD4+ T cells." J. Allergy Clin Immunol., vol. 100, No. 4, 1997, pp. 511-519.
Wikipedia entry for "Multiprotein complex". Retrieved Dec. 20, 2013 from http://en.wikipedia.org/wiki/Multiprotein_complex, 5 pgs.
Woltman, A. et al. "Interleukin-17 and CD4O-Ligand Synergistically Enhance Cytokine and Chemokine Production by Renal Epithelial Cells." J Am Soc Nephrol, vol. 11, 2000, pp. 2044-2055.
Wright, J. et al. "Identification of an Interleukin 17F/17A Heterodimer in Activated Human CD4+ T Cells." The Journal of Biological Chemistry, vol. 282, No. 18, 2007, pp. 13447-13455.
Yao, Z. et al. "Human IL-17: A Novel Cytokine Derived from T Cells." J. Immunol, vol. 115, No. 12, 1995, pp. 5483-5486.
Ye, P. et al. "Interleukin-17 and Lung Host Defense against Klebsiella pneumonia Infection." Am. J. Respir. Cell Mol. Biol., vol. 25, 2001, pp. 335-340.
Zenapax(R) Product Insert, Roche, 1997, 2 pgs.

*Figure 5:*

| | |
|---|---|
| Class 1 Family 1 01D02 ( SEQ ID NO: 623 ) | EVQLVESGGGLVQAGGSLRLSCAASGLSFSSYALGWFRQAPGKERDFVAAINWSGDNTHYADSVKGRFTISRDNAKNTVSLQMNSLKPEDTAVYYCAAQLGYESGYSLTYDYDYWGQGTQVTVSS |
| Class 1 Family 2 01G03 ( SEQ ID NO: 624 ) | EVQLVESGGGLVQAGGSLRLSCAASERTISNYDMGWFRQAPGKERELIAADISWSALNTNYADSVKGRFTISRDNAKNMVYLQMNNLKPEDTAVYYCAARRSGYASFDNWGQGTQVTVSS |
| Class 1 Family 3 02E03 ( SEQ ID NO: 625 ) | EVQLVESGGGLVQPGGSLRLSCAASGFTFSSYAMSWARQAPGEGLEWVSDINSGGTRTTYADSVKGRFTISRDNAKNTLYLQMNSLKPEDTAVYVCAKLSVFRSQLGGKYYGGDYENRGQGTQVTVSS |
| Class 1 Family 4 03B08 ( SEQ ID NO: 626 ) | EVQLVESGGGLVQAGGSLRLSCAASGFTFDDYAIGWFRQAPGKEREGVSCISSSDGSIYYADSVKGRFTISSDNAKNTVYLQMNSLKPEDTAVYHCARFGRTGWAEECVDYDYWGQGTQVTVSS |
| Class 1 Family 5 03E05 ( SEQ ID NO: 627 ) | EVQLVESGGGLVQAGGSLRLSCAASGVTFDDYSIGWFRQAPGKEREGVSCISSSDGIPYYSDFVKGRFTTSIDNAKNTVYLQMNSLKPEDTAVYYCAAGFGRLCAEFDSWGQGTQVTVSS |
| Class 2 Family 6 01D06 ( SEQ ID NO: 628 ) | EVQLVESGGGLVQAGGSLRLSCAADGRTFSTYGMTWFRQVPGKEREFVAHIPRSTYSPYYANSVKGRFTIARDDAKSTVYLQMNSLKPEDTAVYYCAVFTGGTYYVPTAYDYWGQGTQVTVSS |
| Class 2 Family 7 02A08 ( SEQ ID NO: 629 ) | EVQLVESGGGVVQPGGSLRLSCADSERSFSFNAMGWFRQAPGKEREFVAAISATGDDTYYADSVKGRFAISRDTARNTVYLQMNSLKPEDTAVYYCGARVNFDGTVSYTNDYAYWGQGTQVTVSS |
| Class 2 Family 8 02A10 ( SEQ ID NO: 630 ) | EVQLVESGGGLVQPGGSLRLSCAASGFALGYYAIGWFRQAPGKEREGVSCDSSSDGRTYYGDSVKGRFTISTDSAKNTVYLQMNSLKPEDTAVYYCATCTDFEYDYWGQGTQVTVSS |
| Class 2 Family 8 04B09 ( SEQ ID NO: 631 ) | EVQLVESGGGLVQPGGSLRLSCAASGFTLGYYAIGWFRQAPGKEREGVSCDSSSDGDTYYANSVKGRFTISTDNGKNTVYLQMNSLKPEDTAVYYCATCTDWNYDYWGQGTQVTVSS |
| Class 2 Family 9 03C07 ( SEQ ID NO: 632 ) | EVQLVESGGGLVQAGGSLRLSCAASGFTFDDYAIGWFRQAPGKEREAVSCFSSSDGSIYYADSVKGRFTISSDNAKNTVYLQMNSLKPEDTAVYYCAGGGGSYYYTQLNYCYDMDYWGKGTQVTVSS |
| Class 2 Family 10 04A02 ( SEQ ID NO: 633 ) | EVQLVESGGGLVQPGGSLRLSCAASRNINIINYMAWYRQAPGNQRELVAAMTSDATTEYADSVKGRFTISRDIPENTVYLQMNSLKPEDTAVYYCNAKGIWDYLGRRDFGDYWGQGTQVTVSS |

*Figure 5 (continued):*

| | |
|---|---|
| Class 2 Family 11 04B10 ( SEQ ID NO: 634 ) | EVQLVESGGGLVQAGGSQSLSCVASGTIVNINVMGWYRQAPGKQRELVALITSGGGTTYGDSVKGRFTISIDNAKNTVILQMNSLEAEDTAVYYCAAEIGYYSGGTYFSSEAHWGQGTQVTVSS |
| Class 2 Family 11 04G01 ( SEQ ID NO: 635 ) | EVQLVESGGGLVQAGGSQRLSCTASGTIVNIHVMGWYRQAPGKQRELVALIFSGGSADYADSVKGRFTISRDNAKNTVYLEMNSLKAEDTAVYYCAAEIGYYSGGTYYSSEAHWGQGTQVTVSS |
| Class 2 Family 12 04F09 ( SEQ ID NO: 636 ) | EVQLVESGGGLVQPGGSLRLSCAASGRTFSTHAMGWFRQAPGKERDFVAAIRWSDGSSFYADSVKGRFTISRDNAKNAVYLQSNSLKSEDTAVYVCYADVEGPTALHKYWGRGTQVTVSS |
| Class 2 Family 13 09D10 ( SEQ ID NO: 637 ) | EVQLVESGGGLVQAGGSLSLSCAASGSVFRIDVMRWHRQAPGKQREFLASIASGGTTNYADSVKGRFTISRDNAKNTVYLQMNSLKPEDTAVYYCGANAESGPYTYWGLGTQVTVSS |
| Class 2 Family 14 09G10 ( SEQ ID NO: 638 ) | EVQLVESGGGLVQAGGSLRLSCAASDSVFTAKAVGWYRQPPGLQREWVAIITSGGKTNYADSSVKGRFTVSVDKVKNTVTLQMNSLKPEDTAVYYCYAQWMGRDYWGQGTQVTVSS |
| Class 2 Family 15 11A06 ( SEQ ID NO: 639 ) | EVQLVESGGGLVQPGESLRLSCKASGFSLDYYALGWFRQAPGKEREGISCITSSDASAYYTDSVKGRFTISRDNSKNTVYLQMNSLKTEDTAIYYCAAALLTCSSYYDAYTYWGQGTQVTVSS |
| Class 3 Family 16 06E11 ( SEQ ID NO: 640 ) | EVQLVESGGGLVQAGGSLRLSCPVSGRAFSRGRLGWFRQAPGKEREFVAVAHWSGAITSYADSVKGRFTFSRDNAKNTMNLQMNSLKPEDTAVYYCAADSETSGNWVYWGQGTQVTVSS |
| Class 3 Family 17 07B09 ( SEQ ID NO: 641 ) | EVQLVESGGGLVQAGGSLRLSCGASGGTFSSYATGWFRQAPGKEREFVAVLRWSDGHTAYADSVKGRFTISRDGAKNTMYLQMSSLKPEDTAIYYCTTATRPGEWDYWGQGTQVTVSS |
| Class 3 Family 17 24G10 ( SEQ ID NO: 642 ) | EVQLVESGGGLVQAGGSLRLSCGAAGGTFSSYATGWFRQAPGKEREFVAVFRWSDSHTAYADSVKGRFTISRDGAKNTLYLQMSSLKPEDTAIYYCTTATRPGEWDYWGQGTQVTVSS |
| Class 3 Family 18 07B11 ( SEQ ID NO: 643 ) | EVQLVESGGGLVQAGGSLRLSCVASGRAFSSYVMGWFRQAPGMEREFVALIRWSDGITGYVDSVKGRFTISRDNAKNTVYLQMNSLKPEDTAVYYCAAAVRPGDYDYWGQGTQVTVSS |
| Class 3 Family 19 08A08 ( SEQ ID NO: 644 ) | EVQLVESGGGLVQAGGSLRLSCAASGRTFRPYRMGWFRRAPGKAREFVTLISWSSGRTSYADSVKGRFTISRDSAKNAVYLQMDNLKPEDTAVYFCAVDLSGDAVYDSWGQGTQVTVSS |
| Class 3 Family 20 08B07 ( SEQ ID NO: 645 ) | EVQLVESGGGLVQPGGSLRLSCAASGRDFRVKNVGWIRQAPGKQRELVATITVGGSTNYADSAKGRFTISRDNAKNTVYLQMSSLKPEDTAVYYCNAVATVTDYTGTYSDGFWGQGTQVTVSS |

*Figure 5 (continued):*

| | |
|---|---|
| Class 3 Family 21 08H01 ( SEQ ID NO: 646 ) | EVQLVESGGGLVQAGGSLRLSCGASGGTFSSYATGWFRQAPGKEREFVAVLRWSDSHTAYADSVEGRFTISRDGAKNTVYLQMSSLKPEDTAIYYCTTGTRPGEWHYWGQGTQVTVSS |
| Class 3 Family 22 12A09 ( SEQ ID NO: 647 ) | EVQLVESGGGLVQPGGSLRLSCAASGFTFSSYRMAWVRQAPGKGLEWVSSTSTGGEMTNYADSVKGRFTISRDNAKNTLHLQMNSLKPEDTALYYCAAGTSAGHWSTGGQGTQVTVSS |
| Class 3 Family 23 16A04 ( SEQ ID NO: 648 ) | EVQLVESGGGLVQAGGSLRLSCAASGRTFSSYVVGWFRQAPGKEREFIGAISGSGDSIYYAVSEKDRFTISRDNGKNTLYLQMSSLKAEDTAVYYCTADQEFGYLRFGRSEYWGQGTQVTVSS |
| Class 3 Family 24 24B08 ( SEQ ID NO: 649 ) | EVQLVESGGGLVQAGGSLRLSCAVSGGTFSTYKMGWFRQAPGKEREIVARISTNGPTAYAEFVKGRFTVSRENTKNTVYLQMNSLNIEDTAVYYCAAGYDSLFAGYDYWGQGTQVTVSS |
| Class 4 Family 25 01A01 ( SEQ ID NO: 650 ) | EVQLVESGGGLVQAGGSLRLSCAASGFTFDDYDIGWFRQAPGKEREGVSCFTSSDGRTFYADSVKGRFTVSADNAKNTVYLQMNSLEPEDTAVYFCAAVNTFDESAYAAFACYDVVRWGQGTQVTVSS |
| Class 4 Family 26 09B09 ( SEQ ID NO: 651 ) | EMQLVESGGGLVQPGGSLRLSCAASGFTFSSYWMYWARQAPGKGLEWISALAPGGDDEYYADSVNGRFTISRDNAENSLYLQMNSLKSEDTAVYYCAKDHNVGYRTGEYDYGGQGTQVTVSS |
| Class 4 Family 26 09E11 ( SEQ ID NO: 652 ) | EVQLVESGGGLVQPGGSLRLSCAASGFTFSSYWMYWVRQAPGKGLEWISALAPGGDNRYYADSVNGRFTISRDNAENSLYLQMNSLKSEDTAVYYCAKDHNVGYRTGEYDYGGQGTQVTVSS |
| Class 4 Family 26 10A04 ( SEQ ID NO: 653 ) | EVQLVESGGGLVQPGGSLRLSCAASGFTFSSYWMYWVRQAPGKGLEWISALAPGGGNRYYAESVNGRFTISRDNAKNSLYLQMNSLKSEDTAVYYCAKDHNVGYRTGEYDYGGQGTQVTVSS |
| Class 4 Family 26 10A05 ( SEQ ID NO: 654 ) | EVQLVESGGGLVQPGGSLRLSCAASGFTFSNYWMYWVRQAPGKGLEWISALAPGGDNRYYADSVNGRFTISRDNAENSLYLQMNSLKSEDTAVYYCAKDHNVGYRTGEYDYGGQGTQVTVSS |
| Class 4 Family 26 10D11 ( SEQ ID NO: 655 ) | EVQLVESGGGLVQAGGSLRLSCAASGFTFSSYWMYWVRQAPGKGLEWISALAPGGEHRYYADSVNGRFTISRDNAKNSLYLQMNSLKSEDTAVYYCAKDHNVGYRTGEYDYGGQGTQVTVSS |
| Class 4 Family 26 10F02 ( SEQ ID NO: 656 ) | EVQLVESGGGLVQPGGSLRLSCAASGFTFSSYWMYWVRQAPGKGLEWISALAPGGGNAYYADSVNGRFTISRDNAENLLYLQMNSLKSEDTAVYYCAKDHNVGYRTGEYDYGGQGTQVTVSS |

*Figure 5 (continued):*

| | |
|---|---|
| Class 4 Family 27 11A02 ( SEQ ID NO: 657 ) | EVQLVESGGGLVQAGGSLRLSCAASGVIFRLNAMGWYRAAPGKQRELVAIIINGGSTNYADSVKGRFTISRDSAKNAVYLQMNSLKPEDTAVYYCYYNIPGDVYWGQGTQVTVSS |
| Class 4 Family 27 11A07 ( SEQ ID NO: 658 ) | EVQLVESGGGLVQAGGSLRLSCAAPGVIFRLNAMGWYRAAPGKQRELVAIIANGGSTNYADSVKGRFTISRDSAKNAVYLQMNSLKPEDTAVYYCYYNIPGDVYWGQGTRVTVSS |
| Class 4 Family 27 11C08 ( SEQ ID NO: 659 ) | EVQLVESGGGLVQAGGSLRLSCAASGVIFRLNAMGWYRAAPGKQRELVAIIVNGGSTNYADSVKGRFTISRDSAKNAVYLQMNSLKPEDTAVYYCYYNIPGDVYWGQGTQVTVSS |
| Class 4 Family 27 11C09 ( SEQ ID NO: 660 ) | EVQLVESGGGLVQAGGSLRLSCAASGVIFRLNAMGWYRAAPGKQRELVAIIVNGGSTNYADSVKGRFTISRDSAKNAVYLQMDSLKPEDTAVYYCYYNIPGDVYWGQGTQVTVSS |
| Class 4 Family 27 12H11 ( SEQ ID NO: 661 ) | EVQLVESGGGLVQPGGSLRLSCAASGVIFRLNAMGWYRAAPGKQRELVAIIVNGGSTNYADSVKGRFTISRDNAKNAVYLQMNSLKPEDTAVYYCYYNIPGDVYWGQGTQVTVSS |
| Class 4 Family 28 13B03 ( SEQ ID NO: 662 ) | EVQLVESGGGSVQAGDSLRLSCAASGRANSINWFGWFRQTPGKEREFVAGIRWSDAYTEYANSVKGRFTISRDNAKNTVDLQMDSLKPEDTAVYYCVLDLSTVRYWGQGTQVTVSS |
| Class 4 Family 28 13D05 ( SEQ ID NO: 663 ) | EVQLVESGGGSVQAGDSLRLSCAASGRANSINWFGWFRQTPGKEREFVAGIRWTDAYTEYAASVKGRFTISRDNAKNTVGLQMDSLKPEDTAVYYCVLDLSTVRYWGQGSQVTVSS |
| Class 4 Family 29 13E02 ( SEQ ID NO: 664 ) | EVQLVESGGGLVQAGGSLRLSCAASGRTYDAMGWLRQAPGKEREFVAAISGSGDDTYYADSVKGRFTISKDNAGITMYLQMNSLKPEDTAVYYCATRRGLYYVWDSNDYENWGQGTQVTVSS |
| Class 4 Family 29 01D08 ( SEQ ID NO: 665 ) | EVQLVESGGGLVQAGGSLRLSCAASGRTYYAMGWLRQAPGKEREFVAAISGSGDDTYYADSVKGRFTISKDNAGITMYLEMNSLKPEDTAVYYCATRRGRYYVWDSNDYENWGQGTQVTVSS |
| Class 4 Family 29 13E07 ( SEQ ID NO: 666 ) | EVQLVESGGGLVQAGGSLRLSCAASGRTYYAMGWLRQAPGKEREFVAAISGSGDDTYYADSVKGRFTISKDNAGITMYLQMNSLKPEDTAVYYCATRRGLYYVWDSNDYENWGQGTQVTVSS |
| Class 4 Family 29 13G06 ( SEQ ID NO: 667 ) | EVQLVESGGGLVQAGGSLRLSCAASGRTYHAMGWLRQAPGKEREFVAAVSGSGDDTYYADSVKGRFTISKDNAGITMYLQMNSLKPEDTAVYYCATRRGLYYVWDSNDYENWGQGTQVTVSS |

*Figure 5 (continued):*

| | |
|---|---|
| Class 4 Family 29 13H05 ( SEQ ID NO: 668 ) | EVQLVESGGGLVQAGGSLRLSCAASGRTYDAMGWFRQAPG KEREFVAAISGSGEDTYYADSVKGRFTCSKDNAKDTMYLQ MNSLKPEDTAVYYCATRRGLYFITDSNDYENWGQGTQVTV SS |
| Class 4 Family 30 13E05 ( SEQ ID NO: 669 ) | EVQLVESGGGKVQAGDSLTLSCVASGGTFSNYAAWFRQAP GKDRRELVVSIFRTGSITYTADSVKGRFTASRVNTKNTVYLQ MNSLKPEDTAVYYCASAYNPGVGYDYWGQGTQVTVSS |
| Class 4 Family 30 17B03 ( SEQ ID NO: 670 ) | EVQLVESGGGLVQAGGSLRLSCEASGGTFSNYAAWFRQGP GKGRELVVSIFRSGTITYTADSVKGRFTASRVNTKNTVYLQ MNSLKPEDTGIYYCASAYNPGIGYDYWGQGTQVTVSS |
| Class 4 Family 30 17D08 ( SEQ ID NO: 671 ) | EVQLVESGGGLVQAGDSLTLSCVASGGTFSNYAAWFRQAP GKDRRELVVSIFRTGSITYTADSVKGRFTASRVNTKNTVYLQ MNSLKPEDTAVYYCASAYNPGVGYDYWGQGTQVTVSS |
| Class 4 Family 30 17E05 ( SEQ ID NO: 672 ) | EVQLVESGGGLVQAGDSLRLSCEASGGTFSNYAAWFRQGP GKGRELVVSIFRSGTITYTADSVKGRFTASRVNTKNTVYLQ MNSLKPEDTGIYYCASAYNPGIGYDYWGQGTQVTVSS |
| Class 4 Family 30 17G08 ( SEQ ID NO: 673 ) | EVQLVESGGGLVQPGGSLRLSCEASGGTFSNYAAWFRQGPG KGRELVVSIFRSGTITYTADSVKGRFTASRVNTKNTVYLQM NSLKPEDTGIYYCASAYNPGIGYDYWGQGTQVTVSS |
| Class 4 Family 30 17H04 ( SEQ ID NO: 674 ) | EVQLVESGGGLVQAGDSLRLSCVASGGTFSNYAAWFRQAP GKGRELILSIFRSGSITYTADSVKGRFTGSRVNTKNTAYLQM NNLKPEDTAVYYCASAYNPGIGYDYWGQGTQVTVSS |
| Class 4 Family 30 17H07 ( SEQ ID NO: 675 ) | EVQLVESGGGLVQAGDSLTLSCVASGGTFSNYAAWFRQAP GKDRRELVVSIFRTGSITYTADSVKGRFTASRVNTKNTVYLQ MNSLKPEDTAVYYCASAYNPGVGYDYWGQGTQVTVSS |
| Class 4 Family 31 01C09 ( SEQ ID NO: 676 ) | EVQLVKSGGGLVQAGGSLKLSCAASGRTFTTYPMGWFRQA PGKEREFVGAISMSGEDTIYATSVKGRFTISRDDARNTVTLH MTSLKPEDTAVYYCAARTSYNGRYDYIDDYSYWGQGTQVT VSS |
| Class 4 Family 31 01F10 ( SEQ ID NO: 677 ) | EVQLVESGGGLVQAGGSLRLSCAASGRTFTTYPMGWFRQA PGKEREFVAAISMSGEDAAYATSVKGRFTISRDNARNTVYL HMTTLKPEDTAVYYCAARTSYNGIYDYIDDYSYWGQGTQ VTVSS |
| Class 4 Family 31 02D02 ( SEQ ID NO: 678 ) | EVQLVESGGGLVQAGGSLKLSCARSGRTFTTYPMGWFRQA PGKEREFVAAISMSGDDTAYATFVKGRFTIVRDDDKNTVYL HMTSLKPEDTAVYYCAARTSYSGTYDYIDDYSYWGQGTQV TVSS |

*Figure 5 (continued):*

| | |
|---|---|
| Class 4 Family 31 13A08 ( SEQ ID NO: 679 ) | EVQLVESRGRLVQAGGSLRLSCAASGRTFTSYPMGWFRQAPGKEREFVAAISMSGDDAAYADFVRGRFTISRDDARNTVYLHMTSLKPEDTAVYYCAARTSYDGTYDYIDDYSYWGQGTQVTVSS |
| Class 4 Family 31 13B05 ( SEQ ID NO: 680 ) | EVQLVESGGRLVQAGGSLRLSCAASGRTFTSYPMGWFRQAPGKEREFVAAISMSGDDTAYTDFVRGRFTISRDDARNTVYLHMTSLKPEDTAVYYCAARTSYDGTYDYIDDYSYWGQGTQVTVSS |
| Class 4 Family 31 13C06 ( SEQ ID NO: 681 ) | EVQLVESGGRLVQAGGSLRLSCAASGRTFTSYPMGWFRQAPGKEREFVAAISMSGDDAAYADFVRGRFTISRDDARNTVYLHMTSLKPEDTAVYYCAARTSYDGTYDYIDDYSYWGQGTQVTVSS |
| Class 4 Family 31 13E01 ( SEQ ID NO: 682 ) | EVQLVESEGGLVQAGGSLRLSCARSGHAFTSYPMGWFRQAPGKEREFVAAISMSGDDTIYRDFVKGRFTISRDNARNTVYLHMTSLKPEDTAVYYCAARTSYDGRYDYIDDYSYWGQGTQVTVSS |
| Class 4 Family 31 13E03 ( SEQ ID NO: 683 ) | EVQLVESGGGLVQAGGSLRLSCAASGRTFTTYPMGWFRQAPGKEREFVAAISMSGDDTAYATFVKGRFTISRDSARNTVYLHMTRLKPEDTAVYSCAARTSYDGRYDYIDDYSDWGQGTQVTVSS |
| Class 4 Family 31 13E08 ( SEQ ID NO: 684 ) | EVQLVESRGGLVQAGGSLRLSCAGSGRTLYSYPMGWFRQAPGKEREFVAAISMSGDDTAVATFVKGRFTISRDNARNTVYLHMTSLKPEDTAVYHCAARTSYSGRYDYIDDYSYWGQGTQVTVSS |
| Class 4 Family 31 13G04 ( SEQ ID NO: 685 ) | EVQLVESGGGLVQAGGSLRLSCAASGRTLYSYPMGWFRQAPGKEREFVAAISMSGDDTAVATFVKGRFTISRDNARNTVYLHMSSLKPEDTAVYHCAARTSYSGRYDYIDDYSYWGQGTQVTVSS |
| Class 4 Family 31 13G05 ( SEQ ID NO: 686 ) | EVQLVESGGGLVQAGGSLELSCARSGRTFTTYPMGWFRQAPGKEREFVAAISMSGDDTAYATFVKGRFTFSRDDDKNTVYLHMTSLKPEDTAVYYCAARTSYSGMYDYIHDYSYWGQGTQVTVSS |
| Class 4 Family 31 13G08 ( SEQ ID NO: 687 ) | EVQLVESGGGLVQAGGSLRLSCAASGRTFFSYPMGWFRQAPGKEREFVAAISMSGDDSAYRDFVKGRFTISRDNARDTVYLHMTSLKPEDTAIYYCAARTSYNGRYDYIDDYSYWGQGTQVTVSS |
| Class 4 Family 31 13H03 ( SEQ ID NO: 688 ) | EVQLVESGGGLVQAGGSLRLSCAASGRTFTTYPMGWFRQAPGKEREFVAAISMSGDDTAYATFVKGRFTISRDNARNTVYLHMTRLKPEDTAVYSCAARTSYDGRYDYIDDYSDWGQGTQVTVSS |

*Figure 5 (continued):*

| | |
|---|---|
| Class 4 Family 31 17C01 ( SEQ ID NO: 689 ) | EVQLVESGGRLVQAGGSLRLPCAASGRTFTSYPMGWFRQAPGKEREFVAAISMSGDDAAYADFVRGRFTISRDDARNTVYLHMTSLKPEDTAVYYCAARTSYDGTYDYIDDYSYWGQGTQVTVSS |
| Class 4 Family 32 15A08 ( SEQ ID NO: 690 ) | EVQLVESGGGLVQPGGSLRLSCAASGFTLDYYAIGWFRQAPGKEREGVSCVSSSDGRTAYADSVKGRFTISRDNAKNTVYLQMNSLKPEDTAVYYCATVMEYGLGCTTDVLDAWGQGTLVTVSS |
| Class 4 Family 33 13G02 ( SEQ ID NO: 691 ) | EVQLVESRGGLVQAGGSLRLSCAASGGTFSVFAMRWFRQAPGKEREFVAGISWTGGTTYYADSVKGRFTMSADNAKNTVYLQMNSLKPEDTAVYYCAVDVGGGSDRYLGQGTQVTVSS |
| Class 4 Family 33 17E02 ( SEQ ID NO: 692 ) | EVQLVESRGGLVQAGGSLRLSCAASGGTFSVFAMRWFRQAPGKEREFVAGISWTGGTTYYADSVKGRFTMSADNAKNTVYLQMNSLKPEDTAVYYCAVDVGGGSDRYLGQGTQVTVSS |
| Class 4 Family 33 18B05 ( SEQ ID NO: 693 ) | EVQLVKSGGGLVQPGGSLRLSCAASGGTFSLFAMGWFREAPGKEREFVAAIRWSDGSSYYADSVKGRFTISRDNAKNAVHLQSNSLKSEDTAVYYCYADVQGGLHRYWGQGTQVTVSS |

*Figure 6:*

| | |
|---|---|
| IL17MS0026 (04G01-9GS-ALB8-9GS-16A04) (SEQ ID NO:710) | EVQLVESGGGLVQAGGSQRLSCTASGTIVNIHVMGWYRQAPG KQRELVALIFSGGSTDYADSVKGRFTISRDNAKNTVYLEMNSL KAEDTAVYYCAAEIGYYSGGTYYSSEAHWGQGTQVTVSSGGG GSGGGSEVQLVESGGGLVQPGNSLRLSCAASGFTFSSFGMSWV RQAPGKGLEWVSSISGSGSDTLYADSVKGRFTISRDNAKTTLYL QMNSLRPEDTAVYYCTIGGSLSRSSQGTLVTVSSGGGGSGGGS EVQLVESGGGLVQAGGSLRLSCAASGRTFSSYVVGWFRQAPG KEREFIGAISGSGDSIYYAVSEKDRFTISRDNGKNTLYLQMSSLK AEDTAVYYCTADQEFGYLRFGRSEYWGQGTQVTVSS |
| IL17MS0070 (16A04-9GS-ALB8-9GS-04G01) (SEQ ID NO:711) | EVQLVESGGGLVQAGGSLRLSCAASGRTFSSYVVGWFRQAPG KEREFIGAISGSGDSIYYAVSEKDRFTISRDNGKNTLYLQMSSLK AEDTAVYYCTADQEFGYLRFGRSEYWGQGTQVTVSSGGGGSG GGSEVQLVESGGGLVQPGNSLRLSCAASGFTFSSFGMSWVRQA PGKGLEWVSSISGSGSDTLYADSVKGRFTISRDNAKTTLYLQM NSLRPEDTAVYYCTIGGSLSRSSQGTLVTVSSGGGGSGGGSEVQ LVESGGGLVQAGGSQRLSCTASGTIVNIHVMGWYRQAPGKQR ELVALIFSGGSTDYADSVKGRFTISRDNAKNTVYLEMNSLKAE DTAVYYCAAEIGYYSGGTYYSSEAHWGQGTQVTVSS |
| IL17MS0089 (02A08-35GS-16A04-9GS-ALB8) (SEQ ID NO:712) | EVQLVESGGGVVQPGGSLRLSCADSERSFSFNAMGWFRQAPG KEREFVAAISATGDDTYYADSVKGRFAISRDTARNTVYLQMNS LKPEDTAVYYCGARVNFDGTVSYTNDYAYWGQGTQVTVSSG GGGSGGGGSGGGGSGGGGSGGGGSGGGGSGGGGSEVQLVES GGGLVQAGGSLRLSCAASGRTFSSYVVGWFRQAPGKEREFIGA ISGSGDSIYYAVSEKDRFTISRDNGKNTLYLQMSSLKAEDTAVY YCTADQEFGYLRFGRSEYWGQGTQVTVSSGGGGSGGGSEVQL VESGGGLVQPGNSLRLSCAASGFTFSSFGMSWVRQAPGKGLE WVSSISGSGSDTLYADSVKGRFTISRDNAKTTLYLQMNSLRPED TAVYYCTIGGSLSRSSQGTLVTVSS |
| IL17MS0096 (03C07-35GS-16A04-9GS-ALB8) (SEQ ID NO:713) | EVQLVESGGGLVQAGGSLRLSCAASGFTFDDYAIGWFRQAPGK EREAVSCFSSSDGSIYYADSVKGRFTISSDNAKNTVYLQMNSLK PEDTAVYYCAGGGGSYYYTQLNYCYDMDYWGKGTQVTVSSG GGGSGGGGSGGGGSGGGGSGGGGSGGGGSGGGGSEVQLVES GGGLVQAGGSLRLSCAASGRTFSSYVVGWFRQAPGKEREFIGA ISGSGDSIYYAVSEKDRFTISRDNGKNTLYLQMSSLKAEDTAVY YCTADQEFGYLRFGRSEYWGQGTQVTVSSGGGGSGGGSEVQL VESGGGLVQPGNSLRLSCAASGFTFSSFGMSWVRQAPGKGLE WVSSISGSGSDTLYADSVKGRFTISRDNAKTTLYLQMNSLRPED TAVYYCTIGGSLSRSSQGTLVTVSS |

*Figure 6 (continued):*

| | |
|---|---|
| IL17MS0101 (04B09-35GS-07B11-9GS-ALB8) (SEQ ID NO:714) | EVQLVESGGGLVQPGGSLRLSCAASGFTLGYYAIGWFRQAPGKEREGVSCDSSSDGDTYYANSVKGRFTISTDNGKNTVYLQMNSLKPEDTAVYYCATCTDWNYDYWGQGTQVTVSSGGGGSGGGGSGGGGSGGGGSGGGGSGGGGSGGGGSEVQLVESGGGLVQAGGSLRLSCVASGRAFSSYVMGWFRQAPGMEREFVALIRWSDGITGYVDSVKGRFTISRDNAKNTVYLQMNSLKPEDTAVYYCAAAVRPGDYDYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |
| IL17MS0110 (04G01-35GS-16A04-9GS-ALB8) (SEQ ID NO:715) | EVQLVESGGGLVQAGGSQRLSCTASGTIVNIHVMGWYRQAPGKQRELVALIFSGGSTDYADSVKGRFTISRDNAKNTVYLEMNSLKAEDTAVYYCAAEIGYYSGGTYYSSEAHWGQGTQVTVSSGGGGSGGGGSGGGGSGGGGSGGGGSGGGGSGGGGSEVQLVESGGGLVQAGGSLRLSCAASGRTFSSYVVGWFRQAPGKEREFIGAISGSGDSIYYAVSEKDRFTISRDNGKNTLYLQMSSLKAEDTAVYYCTADQEFGYLRFGRSEYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |
| IL17MS0113 (09G10-35GS-06E11-9GS-ALB8) (SEQ ID NO:716) | EVQLVESGGGLVQAGGSLRLSCAASDSVFTAKAVGWYRQPPGLQREWVAIITSGGKTNYADSSVKGRFTVSVDKVKNTVTLQMNSLKPEDTAVYYCYAQWMGRDYWGQGTQVTVSSGGGGSGGGGSGGGGSGGGGSGGGGSGGGGSGGGGSEVQLVESGGGLVQAGGSLRLSCPVSGRAFSRGRLGWFRQAPGKEREFVAVAHWSGAITSYADSVKGRFTFSRDNAKNTMNLQMNSLKPEDTAVYYCAADSETSGNWVYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |
| IL17MS0119 (09G10-35GS-24G10-9GS-ALB8) (SEQ ID NO:717) | EVQLVESGGGLVQAGGSLRLSCAASDSVFTAKAVGWYRQPPGLQREWVAIITSGGKTNYADSSVKGRFTVSVDKVKNTVTLQMNSLKPEDTAVYYCYAQWMGRDYWGQGTQVTVSSGGGGSGGGGSGGGGSGGGGSGGGGSGGGGSGGGGSEVQLVESGGGLVQAGGSLRLSCGAAGGTFSSYATGWFRQAPGKEREFVAVFRWSDSHTAYADSVKGRFTISRDGAKNTLYLQMSSLKPEDTAIYYCTTATRPGEWDYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |

*Figure 6 (continued):*

| | |
|---|---|
| IL17MS0123 (11A06-35GS-08H01-9GS-ALB8) (SEQ ID NO:718) | EVQLVESGGGLVQPGESLRLSCKASGFSLDYYALGWFRQAPGKEREGISCITSSDASAYYTDSVKGRFTISRDNSKNTVYLQMNSLKTEDTAIYYCAAALLTCSSYYDAYTYWGQGTQVTVSSGGGGSGGGGSGGGGSGGGGSGGGGSGGGGSGGGGSEVQLVESGGGLVQAGGSLRLSCGASGGTFSSYATGWFRQAPGKEREFVAVLRWSDSHTAYADSVEGRFTISRDGAKNTVYLQMSSLKPEDTAIYYCTTGTRPGEWHYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |
| IL17MS0131 (06E11-35GS-09G10-9GS-ALB8) (SEQ ID NO:719) | EVQLVESGGGLVQAGGSLRLSCPVSGRAFSRGRLGWFRQAPGKEREFVAVAHWSGAITSYADSVKGRFTFSRDNAKNTMNLQMNSLKPEDTAVYYCAADSETSGNWVYWGQGTQVTVSSGGGGSGGGGSGGGGSGGGGSGGGGSGGGGSGGGGSEVQLVESGGGLVQAGGSLRLSCAASDSVFTAKAVGWYRQPPGLQREWVAIITSGGKTNYADSSVKGRFTVSVDKVKNTVTLQMNSLKPEDTAVYYCYAQWMGRDYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |
| IL17MS0141 (07B11-35GS-04B09-9GS-ALB8) (SEQ ID NO:720) | EVQLVESGGGLVQAGGSLRLSCVASGRAFSSYVMGWFRQAPGMEREFVALIRWSDGITGYVDSVKGRFTISRDNAKNTVYLQMNSLKPEDTAVYYCAAAVRPGDYDYWGQGTQVTVSSGGGGSGGGGSGGGGSGGGGSGGGGSGGGGSGGGGSEVQLVESGGGLVQPGGSLRLSCAASGFTLGYYAIGWFRQAPGKEREGVSCDSSSDGDTYYANSVKGRFTISTDNGKNTVYLQMNSLKPEDTAVYYCATCTDWNYDYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |
| IL17MS0150 (08H01-35GS-11A06-9GS-ALB8) (SEQ ID NO:721) | EVQLVESGGGLVQAGGSLRLSCGASGGTFSSYATGWFRQAPGKEREFVAVLRWSDSHTAYADSVEGRFTISRDGAKNTVYLQMSSLKPEDTAIYYCTTGTRPGEWHYWGQGTQVTVSSGGGGSGGGGSGGGGSGGGGSGGGGSGGGGSGGGGSEVQLVESGGGLVQPGESLRLSCKASGFSLDYYALGWFRQAPGKEREGISCITSSDASAYYTDSVKGRFTISRDNSKNTVYLQMNSLKTEDTAIYYCAAALLTCSSYYDAYTYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |

*Figure 6 (continued):*

| | |
|---|---|
| IL17MS0151 (16A04-35GS-02A08-9GS-ALB8) (SEQ ID NO:722) | EVQLVESGGGLVQAGGSLRLSCAASGRTFSSYVVGWFRQAPGKEREFIGAISGSGDSIYYAVSEKDRFTISRDNGKNTLYLQMSSLKAEDTAVYYCTADQEFGYLRFGRSEYWGQGTQVTVSSGGGGSGGGGSGGGGSGGGGSGGGGSGGGGSGGGGSEVQLVESGGGVVQPGGSLRLSCADSERSFSFNAMGWFRQAPGKEREFVAAISATGDDTYYADSVKGRFAISRDTARNTVYLQMNSLKPEDTAVYYCGARVNFDGTVSYTNDYAYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |
| IL17MS0152 (16A04-35GS-03C07-9GS-ALB8) (SEQ ID NO:723) | EVQLVESGGGLVQAGGSLRLSCAASGRTFSSYVVGWFRQAPGKEREFIGAISGSGDSIYYAVSEKDRFTISRDNGKNTLYLQMSSLKAEDTAVYYCTADQEFGYLRFGRSEYWGQGTQVTVSSGGGGSGGGGSGGGGSGGGGSGGGGSGGGGSGGGGSEVQLVESGGGLVQAGGSLRLSCAASGFTFDDYAIGWFRQAPGKEREAVSCFSSSDGSIYYADSVKGRFTISSDNAKNTVYLQMNSLKPEDTAVYYCAGGGGSYYYTQLNYCYDMDYWGKGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |
| IL17MS0154 (16A04-35GS-04G01-9GS-ALB8) (SEQ ID NO:724) | EVQLVESGGGLVQAGGSLRLSCAASGRTFSSYVVGWFRQAPGKEREFIGAISGSGDSIYYAVSEKDRFTISRDNGKNTLYLQMSSLKAEDTAVYYCTADQEFGYLRFGRSEYWGQGTQVTVSSGGGGSGGGGSGGGGSGGGGSGGGGSGGGGSGGGGSEVQLVESGGGLVQAGGSQRLSCTASGTIVNIHVMGWYRQAPGKQRELVALIFSGGSTDYADSVKGRFTISRDNAKNTVYLEMNSLKAEDTAVYYCAAEIGYYSGGTYYSSEAHWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |
| IL17MS0166 (24G10-35GS-04G01-9GS-ALB8) (SEQ ID NO:725) | EVQLVESGGGLVQAGGSLRLSCGAAGGTFSSYATGWFRQAPGKEREFVAVFRWSDSHTAYADSVKGRFTISRDGAKNTLYLQMSSLKPEDTAIYYCTTATRPGEWDYWGQGTQVTVSSGGGGSGGGGSGGGGSGGGGSGGGGSGGGGSGGGGSEVQLVESGGGLVQAGGSQRLSCTASGTIVNIHVMGWYRQAPGKQRELVALIFSGGSTDYADSVKGRFTISRDNAKNTVYLEMNSLKAEDTAVYYCAAEIGYYSGGTYYSSEAHWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |

*Figure 6 (continued):*

| | |
|---|---|
| IL17MS1001 (01A01-9GS-ALB8-9GS-01A01) (SEQ ID NO:726) | EVQLVESGGGLVQAGGSLRLSCAASGFTFDDYDIGWFRQAPGKEREGVSCFTSSDGRTFYADSVKGRFTVSADNAKNTVYLQMNSLEPEDTAVYFCAAVNTFDESAYAAFACYDVVRWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQAGGSLRLSCAASGFTFDDYDIGWFRQAPGKEREGVSCFTSSDGRTFYADSVKGRFTVSADNAKNTVYLQMNSLEPEDTAVYFCAAVNTFDESAYAAFACYDVVRWGQGTQVTVSS |
| IL17MS1003 (13B03-9GS-ALB8-9GS-13B03) (SEQ ID NO:727) | EVQLVESGGGSVQAGDSLRLSCAASGRANSINWFGWFRQTPGKEREFVAGIRWSDAYTEYANSVKGRFTISRDNAKNTVDLQMDSLKPEDTAVYYCVLDLSTVRYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGSVQAGDSLRLSCAASGRANSINWFGWFRQTPGKEREFVAGIRWSDAYTEYANSVKGRFTISRDNAKNTVDLQMDSLKPEDTAVYYCVLDLSTVRYWGQGTQVTVSS |
| IL17MS1004 (13B05-9GS-ALB8-9GS-13B05) (SEQ ID NO:728) | EVQLVESGGRLVQAGGSLRLSCAASGRTFTSYPMGWFRQAPGKEREFVAAISMSGDDTAYTDFVRGRFTISRDDARNTVYLHMTSLKPEDTAVYYCAARTSYDGTYDYIDDYSYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGRLVQAGGSLRLSCAASGRTFTSYPMGWFRQAPGKEREFVAAISMSGDDTAYTDFVRGRFTISRDDARNTVYLHMTSLKPEDTAVYYCAARTSYDGTYDYIDDYSYWGQGTQVTVSS |
| IL17MS1005 (13E02-9GS-ALB8-9GS-13E02) (SEQ ID NO:729) | EVQLVESGGGLVQAGGSLRLSCAASGRTYDAMGWLRQAPGKEREFVAAISGSGDDTYYADSVKGRFTISKDNAGITMYLQMNSLKPEDTAVYYCATRRGLYYVWDSNDYENWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQAGGSLRLSCAASGRTYDAMGWLRQAPGKEREFVAAISGSGDDTYYADSVKGRFTISKDNAGITMYLQMNSLKPEDTAVYYCATRRGLYYVWDSNDYENWGQGTQVTVSS |

*Figure 6 (continued):*

| | |
|---|---|
| IL17MS1006 (13E05-9GS-ALB8-9GS-13E05) (SEQ ID NO:730) | EVQLVESGGGKVQAGDSLTLSCVASGGTFSNYAAWFRQAPGKDRRELVVSIFRTGSITYTADSVKGRFTASRVNTKNTVYLQMNSLKPEDTAVYYCASAYNPGVGYDYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGKVQAGDSLTLSCVASGGTFSNYAAWFRQAPGKDRRELVVSIFRTGSITYTADSVKGRFTASRVNTKNTVYLQMNSLKPEDTAVYYCASAYNPGVGYDYWGQGTQVTVSS |
| IL17MS1009 (01A01-35GS-01A01-9GS-ALB8) (SEQ ID NO:731) | EVQLVESGGGLVQAGGSLRLSCAASGFTFDDYDIGWFRQAPGKEREGVSCFTSSDGRTFYADSVKGRFTVSADNAKNTVYLQMNSLEPEDTAVYFCAAVNTFDESAYAAFACYDVVRWGQGTQVTVSSGGGGSGGGGSGGGGSGGGGSGGGGSGGGGSGGGGSEVQLVESGGGLVQAGGSLRLSCAASGFTFDDYDIGWFRQAPGKEREGVSCFTSSDGRTFYADSVKGRFTVSADNAKNTVYLQMNSLEPEDTAVYFCAAVNTFDESAYAAFACYDVVRWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |
| IL17MS1010 (11C08-35GS-11C08-9GS-ALB8) (SEQ ID NO:732) | EVQLVESGGGLVQAGGSLRLSCAASGVIFRLNAMGWYRAAPGKQRELVAIIVNGGSTNYADSVKGRFTISRDSAKNAVYLQMNSLKPEDTAVYYCYYNIPGDVYWGQGTQVTVSSGGGGSGGGGSGGGGSGGGGSGGGGSGGGGSGGGGSEVQLVESGGGLVQAGGSLRLSCAASGVIFRLNAMGWYRAAPGKQRELVAIIVNGGSTNYADSVKGRFTISRDSAKNAVYLQMNSLKPEDTAVYYCYYNIPGDVYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |
| IL17MS1011 (13B03-35GS-13B03-9GS-ALB8) (SEQ ID NO:733) | EVQLVESGGGSVQAGDSLRLSCAASGRANSINWFGWFRQTPGKEREFVAGIRWSDAYTEYANSVKGRFTISRDNAKNTVDLQMDSLKPEDTAVYYCVLDLSTVRYWGQGTQVTVSSGGGGSGGGGSGGGGSGGGGSGGGGSGGGGSGGGGSEVQLVESGGGSVQAGDSLRLSCAASGRANSINWFGWFRQTPGKEREFVAGIRWSDAYTEYANSVKGRFTISRDNAKNTVDLQMDSLKPEDTAVYYCVLDLSTVRYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |

*Figure 6 (continued):*

| | |
|---|---|
| IL17MS1012 (13B05-35GS-13B05-9GS-ALB8) (SEQ ID NO:734) | EVQLVESGGRLVQAGGSLRLSCAASGRTFTSYPMGWFRQAPGKEREFVAAISMSGDDTAYTDFVRGRFTISRDDARNTVYLHMTSLKPEDTAVYYCAARTSYDGTYDYIDDYSYWGQGTQVTVSSGGGGSGGGGSGGGGSGGGGSGGGGSGGGGSGGGGSEVQLVESGGRLVQAGGSLRLSCAASGRTFTSYPMGWFRQAPGKEREFVAAISMSGDDTAYTDFVRGRFTISRDDARNTVYLHMTSLKPEDTAVYYCAARTSYDGTYDYIDDYSYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |
| IL17MS1013 (13E02-35GS-13E02-9GS-ALB8) (SEQ ID NO:735) | EVQLVESGGGLVQAGGSLRLSCAASGRTYDAMGWLRQAPGKEREFVAAISGSGDDTYYADSVKGRFTISKDNAGITMYLQMNSLKPEDTAVYYCATRRGLYYVWDSNDYENWGQGTQVTVSSGGGGSGGGGSGGGGSGGGGSGGGGSGGGGSGGGGSEVQLVESGGGLVQAGGSLRLSCAASGRTYDAMGWLRQAPGKEREFVAAISGSGDDTYYADSVKGRFTISKDNAGITMYLQMNSLKPEDTAVYYCATRRGLYYVWDSNDYENWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |
| IL17MS1014 (13E05-35GS-13E05-9GS-ALB8) (SEQ ID NO:736) | EVQLVESGGGKVQAGDSLTLSCVASGGTFSNYAAWFRQAPGKDRRELVVSIFRTGSITYTADSVKGRFTASRVNTKNTVYLQMNSLKPEDTAVYYCASAYNPGVGYDYWGQGTQVTVSSGGGGSGGGGSGGGGSGGGGSGGGGSGGGGSGGGGSEVQLVESGGGKVQAGDSLTLSCVASGGTFSNYAAWFRQAPGKDRRELVVSIFRTGSITYTADSVKGRFTASRVNTKNTVYLQMNSLKPEDTAVYYCASAYNPGVGYDYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |
| IL17MS1015 (17C01-35GS-17C01-9GS-ALB8) (SEQ ID NO:737) | EVQLVESGGRLVQAGGSLRLPCAASGRTFTSYPMGWFRQAPGKEREFVAAISMSGDDAAYADFVRGRFTISRDDARNTVYLHMTSLKPEDTAVYYCAARTSYDGTYDYIDDYSYWGQGTQVTVSSGGGGSGGGGSGGGGSGGGGSGGGGSGGGGSGGGGSEVQLVESGGRLVQAGGSLRLPCAASGRTFTSYPMGWFRQAPGKEREFVAAISMSGDDAAYADFVRGRFTISRDDARNTVYLHMTSLKPEDTAVYYCAARTSYDGTYDYIDDYSYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |

*Figure 6 (continued):*

| | |
|---|---|
| IL17MS2002 (06E11-9GS-ALB8-9GS-13B03) (SEQ ID NO:738) | EVQLVESGGGLVQAGGSLRLSCPVSGRAFSRGRLGWFRQAPGKEREFVAVAHWSGAITSYADSVKGRFTFSRDNAKNTMNLQMNSLKPEDTAVYYCAADSETSGNWVYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGSVQAGDSLRLSCAASGRANSINWFGWFRQTPGKEREFVAGIRWSDAYTEYANSVKGRFTISRDNAKNTVDLQMDSLKPEDTAVYYCVLDLSTVRYWGQGTQVTVSS |
| IL17MS2004 (06E11-9GS-ALB8-9GS-13E02) (SEQ ID NO:739) | EVQLVESGGGLVQAGGSLRLSCPVSGRAFSRGRLGWFRQAPGKEREFVAVAHWSGAITSYADSVKGRFTFSRDNAKNTMNLQMNSLKPEDTAVYYCAADSETSGNWVYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQAGGSLRLSCAASGRTYDAMGWLRQAPGKEREFVAAISGSGDDTYYADSVKGRFTISKDNAGITMYLQMNSLKPEDTAVYYCATRRGLYYVWDSNDYENWGQGTQVTVSS |
| IL17MS2017 (08H01-9GS-ALB8-9GS-13B03) (SEQ ID NO:740) | EVQLVESGGGLVQAGGSLRLSCGASGGTFSSYATGWFRQAPGKEREFVAVLRWSDSHTAYADSVEGRFTISRDGAKNTVYLQMSSLKPEDTAIYYCTTGTRPGEWHYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGSVQAGDSLRLSCAASGRANSINWFGWFRQTPGKEREFVAGIRWSDAYTEYANSVKGRFTISRDNAKNTVDLQMDSLKPEDTAVYYCVLDLSTVRYWGQGTQVTVSS |
| IL17MS2019 (08H01-9GS-ALB8-9GS-13E02) (SEQ ID NO:741) | EVQLVESGGGLVQAGGSLRLSCGASGGTFSSYATGWFRQAPGKEREFVAVLRWSDSHTAYADSVEGRFTISRDGAKNTVYLQMSSLKPEDTAIYYCTTGTRPGEWHYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQAGGSLRLSCAASGRTYDAMGWLRQAPGKEREFVAAISGSGDDTYYADSVKGRFTISKDNAGITMYLQMNSLKPEDTAVYYCATRRGLYYVWDSNDYENWGQGTQVTVSS |

*Figure 6 (continued):*

| | |
|---|---|
| IL17MS2022 (16A04-9GS-ALB8-9GS-13B03) (SEQ ID NO:742) | EVQLVESGGGLVQAGGSLRLSCAASGRTFSSYVVGWFRQAPGKEREFIGAISGSGDSIYYAVSEKDRFTISRDNGKNTLYLQMSSLKAEDTAVYYCTADQEFGYLRFGRSEYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGSVQAGDSLRLSCAASGRANSINWFGWFRQTPGKEREFVAGIRWSDAYTEYANSVKGRFTISRDNAKNTVDLQMDSLKPEDTAVYYCVLDLSTVRYWGQGTQVTVSS |
| IL17MS2024 (16A04-9GS-ALB8-9GS-13E02) (SEQ ID NO:743) | EVQLVESGGGLVQAGGSLRLSCAASGRTFSSYVVGWFRQAPGKEREFIGAISGSGDSIYYAVSEKDRFTISRDNGKNTLYLQMSSLKAEDTAVYYCTADQEFGYLRFGRSEYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQAGGSLRLSCAASGRTYDAMGWLRQAPGKEREFVAAISGSGDDTYYADSVKGRFTISKDNAGITMYLQMNSLKPEDTAVYYCATRRGLYYVWDSNDYENWGQGTQVTVSS |
| IL17MS2031 (24G10-9GS-ALB8-9GS-01A01) (SEQ ID NO:744) | EVQLVESGGGLVQAGGSLRLSCGAAGGTFSSYATGWFRQAPGKEREFVAVFRWSDSHTAYADSVKGRFTISRDGAKNTLYLQMSSLKPEDTAIYYCTTATRPGEWDYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQAGGSLRLSCAASGFTFDDYDIGWFRQAPGKEREGVSCFTSSDGRTFYADSVKGRFTVSADNAKNTVYLQMNSLEPEDTAVYFCAAVNTFDESAYAAFACYDVVRWGQGTQVTVSS |
| IL17MS2042 (01A01-9GS-ALB8-9GS-24G10) (SEQ ID NO:745) | EVQLVESGGGLVQAGGSLRLSCAASGFTFDDYDIGWFRQAPGKEREGVSCFTSSDGRTFYADSVKGRFTVSADNAKNTVYLQMNSLEPEDTAVYFCAAVNTFDESAYAAFACYDVVRWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQAGGSLRLSCGAAGGTFSSYATGWFRQAPGKEREFVAVFRWSDSHTAYADSVKGRFTISRDGAKNTLYLQMSSLKPEDTAIYYCTTATRPGEWDYWGQGTQVTVSS |

*Figure 6 (continued):*

| | |
|---|---|
| IL17MS2043 (13B03-9GS-ALB8-9GS-06E11) (SEQ ID NO:746) | EVQLVESGGGSVQAGDSLRLSCAASGRANSINWFGWFRQTPG<br>KEREFVAGIRWSDAYTEYANSVKGRFTISRDNAKNTVDLQMD<br>SLKPEDTAVYYCVLDLSTVRYWGQGTQVTVSSGGGGSGGGSE<br>VQLVESGGGLVQPGNSLRLSCAASGFTFSSFGMSWVRQAPGKG<br>LEWVSSISGSGSDTLYADSVKGRFTISRDNAKTTLYLQMNSLRP<br>EDTAVYYCTIGGSLSRSSQGTLVTVSSGGGGSGGGSEVQLVES<br>GGGLVQAGGSLRLSCPVSGRAFSRGRLGWFRQAPGKEREFVA<br>VAHWSGAITSYADSVKGRFTFSRDNAKNTMNLQMNSLKPEDT<br>AVYYCAADSETSGNWVYWGQGTQVTVSS |
| IL17MS2046 (13B03-9GS-ALB8-9GS-08H01) (SEQ ID NO:747) | EVQLVESGGGSVQAGDSLRLSCAASGRANSINWFGWFRQTPG<br>KEREFVAGIRWSDAYTEYANSVKGRFTISRDNAKNTVDLQMD<br>SLKPEDTAVYYCVLDLSTVRYWGQGTQVTVSSGGGGSGGGSE<br>VQLVESGGGLVQPGNSLRLSCAASGFTFSSFGMSWVRQAPGKG<br>LEWVSSISGSGSDTLYADSVKGRFTISRDNAKTTLYLQMNSLRP<br>EDTAVYYCTIGGSLSRSSQGTLVTVSSGGGGSGGGSEVQLVES<br>GGGLVQAGGSLRLSCGASGGTFSSYATGWFRQAPGKEREFVA<br>VLRWSDSHTAYADSVEGRFTISRDGAKNTVYLQMSSLKPEDTA<br>IYYCTTGTRPGEWHYWGQGTQVTVSS |
| IL17MS2047 (13B03-9GS-ALB8-9GS-16A04) (SEQ ID NO:748) | EVQLVESGGGSVQAGDSLRLSCAASGRANSINWFGWFRQTPG<br>KEREFVAGIRWSDAYTEYANSVKGRFTISRDNAKNTVDLQMD<br>SLKPEDTAVYYCVLDLSTVRYWGQGTQVTVSSGGGGSGGGSE<br>VQLVESGGGLVQPGNSLRLSCAASGFTFSSFGMSWVRQAPGKG<br>LEWVSSISGSGSDTLYADSVKGRFTISRDNAKTTLYLQMNSLRP<br>EDTAVYYCTIGGSLSRSSQGTLVTVSSGGGGSGGGSEVQLVES<br>GGGLVQAGGSLRLSCAASGRTFSSYVVGWFRQAPGKEREFIGA<br>ISGSGDSIYYAVSEKDRFTISRDNGKNTLYLQMSSLKAEDTAVY<br>YCTADQEFGYLRFGRSEYWGQGTQVTVSS |
| IL17MS2057 (13E02-9GS-ALB8-9GS-06E11) (SEQ ID NO:749) | EVQLVESGGGLVQAGGSLRLSCAASGRTYDAMGWLRQAPGK<br>EREFVAAISGSGDDTYYADSVKGRFTISKDNAGITMYLQMNSL<br>KPEDTAVYYCATRRGLYYVWDSNDYENWGQGTQVTVSSGGG<br>GSGGGSEVQLVESGGGLVQPGNSLRLSCAASGFTFSSFGMSWV<br>RQAPGKGLEWVSSISGSGSDTLYADSVKGRFTISRDNAKTTLYL<br>QMNSLRPEDTAVYYCTIGGSLSRSSQGTLVTVSSGGGGSGGGS<br>EVQLVESGGGLVQAGGSLRLSCPVSGRAFSRGRLGWFRQAPG<br>KEREFVAVAHWSGAITSYADSVKGRFTFSRDNAKNTMNLQMN<br>SLKPEDTAVYYCAADSETSGNWVYWGQGTQVTVSS |

*Figure 6 (continued):*

| | |
|---|---|
| IL17MS2060 (13E02-9GS-ALB8-9GS-08H01) (SEQ ID NO:750) | EVQLVESGGGLVQAGGSLRLSCAASGRTYDAMGWLRQAPGKEREFVAAISGSGDDTYYADSVKGRFTISKDNAGITMYLQMNSLKPEDTAVYYCATRRGLYYVWDSNDYENWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQAGGSLRLSCGASGGTFSSYATGWFRQAPGKEREFVAVLRWSDSHTAYADSVEGRFTISRDGAKNTVYLQMSSLKPEDTAIYYCTTGTRPGEWHYWGQGTQVTVSS |
| IL17MS2061 (13E02-9GS-ALB8-9GS-16A04) (SEQ ID NO:751) | EVQLVESGGGLVQAGGSLRLSCAASGRTYDAMGWLRQAPGKEREFVAAISGSGDDTYYADSVKGRFTISKDNAGITMYLQMNSLKPEDTAVYYCATRRGLYYVWDSNDYENWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQAGGSLRLSCAASGRTFSSYVVGWFRQAPGKEREFIGAISGSGDSIYYAVSEKDRFTISRDNGKNTLYLQMSSLKAEDTAVYYCTADQEFGYLRFGRSEYWGQGTQVTVSS |
| IL17MS2081 (07B11-35GS-01A01-9GS-ALB8) (SEQ ID NO:752) | EVQLVESGGGLVQAGGSLRLSCVASGRAFSSYVMGWFRQAPGMEREFVALIRWSDGITGYVDSVKGRFTISRDNAKNTVYLQMNSLKPEDTAVYYCAAAVRPGDYDYWGQGTQVTVSSGGGGSGGGGSGGGGSGGGGSGGGGSGGGGSGGGGSEVQLVESGGGLVQAGGSLRLSCAASGFTFDDYDIGWFRQAPGKEREGVSCFTSSDGRTFYADSVKGRFTVSADNAKNTVYLQMNSLEPEDTAVYFCAAVNTFDESAYAAFACYDVVRWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |
| IL17MS2092 (16A04-35GS-13B03-9GS-ALB8) (SEQ ID NO:753) | EVQLVESGGGLVQAGGSLRLSCAASGRTFSSYVVGWFRQAPGKEREFIGAISGSGDSIYYAVSEKDRFTISRDNGKNTLYLQMSSLKAEDTAVYYCTADQEFGYLRFGRSEYWGQGTQVTVSSGGGGSGGGGSGGGGSGGGGSGGGGSGGGGSGGGGSEVQLVESGGGSVQAGDSLRLSCAASGRANSINWFGWFRQTPGKEREFVAGIRWSDAYTEYANSVKGRFTISRDNAKNTVDLQMDSLKPEDTAVYYCVLDLSTVRYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |

*Figure 6 (continued):*

| | |
|---|---|
| IL17MS2094 (16A04-35GS-13E02-9GS-ALB8) (SEQ ID NO:754) | EVQLVESGGGLVQAGGSLRLSCAASGRTFSSYVVGWFRQAPGKEREFIGAISGSGDSIYYAVSEKDRFTISRDNGKNTLYLQMSSLKAEDTAVYYCTADQEFGYLRFGRSEYWGQGTQVTVSSGGGGSGGGGSGGGGSGGGGSGGGGSGGGGSGGGGSEVQLVESGGGLVQAGGSLRLSCAASGRTYDAMGWLRQAPGKEREFVAAISGSGDDTYYADSVKGRFTISKDNAGITMYLQMNSLKPEDTAVYYCATRRGLYYVWDSNDYENWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |
| IL17MS2101 (24G10-35GS-01A01-9GS-ALB8) (SEQ ID NO:755) | EVQLVESGGGLVQAGGSLRLSCGAAGGTFSSYATGWFRQAPGKEREFVAVFRWSDSHTAYADSVKGRFTISRDGAKNTLYLQMSSLKPEDTAIYYCTTATRPGEWDYWGQGTQVTVSSGGGGSGGGGSGGGGSGGGGSGGGGSGGGGSGGGGSEVQLVESGGGLVQAGGSLRLSCAASGFTFDDYDIGWFRQAPGKEREGVSCFTSSDGRTFYADSVKGRFTVSADNAKNTVYLQMNSLEPEDTAVYFCAAVNTFDESAYAAFACYDVVRWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |
| IL17MS2108 (01A01-35GS-07B11-9GS-ALB8) (SEQ ID NO:756) | EVQLVESGGGLVQAGGSLRLSCAASGFTFDDYDIGWFRQAPGKEREGVSCFTSSDGRTFYADSVKGRFTVSADNAKNTVYLQMNSLEPEDTAVYFCAAVNTFDESAYAAFACYDVVRWGQGTQVTVSSGGGGSGGGGSGGGGSGGGGSGGGGSGGGGSGGGGSEVQLVESGGGLVQAGGSLRLSCVASGRAFSSYVMGWFRQAPGMEREFVALIRWSDGITGYVDSVKGRFTISRDNAKNTVYLQMNSLKPEDTAVYYCAAAVRPGDYDYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |
| IL17MS2112 (01A01-35GS-24G10-9GS-ALB8) (SEQ ID NO:757) | EVQLVESGGGLVQAGGSLRLSCAASGFTFDDYDIGWFRQAPGKEREGVSCFTSSDGRTFYADSVKGRFTVSADNAKNTVYLQMNSLEPEDTAVYFCAAVNTFDESAYAAFACYDVVRWGQGTQVTVSSGGGGSGGGGSGGGGSGGGGSGGGGSGGGGSGGGGSEVQLVESGGGLVQAGGSLRLSCGAAGGTFSSYATGWFRQAPGKEREFVAVFRWSDSHTAYADSVKGRFTISRDGAKNTLYLQMSSLKPEDTAIYYCTTATRPGEWDYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |

*Figure 6 (continued):*

| | |
|---|---|
| IL17MS2117 (13B03-35GS-16A04-9GS-ALB8) (SEQ ID NO:758) | EVQLVESGGGSVQAGDSLRLSCAASGRANSINWFGWFRQTPGKEREFVAGIRWSDAYTEYANSVKGRFTISRDNAKNTVDLQMDSLKPEDTAVYYCVLDLSTVRYWGQGTQVTVSSGGGGSGGGGSGGGGSGGGGSGGGGSGGGGSGGGGSEVQLVESGGGLVQAGGSLRLSCAASGRTFSSYVVGWFRQAPGKEREFIGAISGSGDSIYYAVSEKDRFTISRDNGKNTLYLQMSSLKAEDTAVYYCTADQEFGYLRFGRSEYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |
| IL17MS2131 (13BE02-35GS-16A04-9GS-ALB8) (SEQ ID NO:759) | EVQLVESGGGLVQAGGSLRLSCAASGRTYDAMGWLRQAPGKEREFVAAISGSGDDTYYADSVKGRFTISKDNAGITMYLQMNSLKPEDTAVYYCATRRGLYYVWDSNDYENWGQGTQVTVSSGGGGSGGGGSGGGGSGGGGSGGGGSGGGGSGGGGSEVQLVESGGGLVQAGGSLRLSCAASGRTFSSYVVGWFRQAPGKEREFIGAISGSGDSIYYAVSEKDRFTISRDNGKNTLYLQMSSLKAEDTAVYYCTADQEFGYLRFGRSEYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |

*Figure 7:*

| | |
|---|---|
| IL17MS3010 (IL17MS04G01 basic) (SEQ ID NO:760) | EVQLVESGGGLVQPGGSQRLSCTASGTIVNIHVMGWYRQAPGKQRELVALIFSGGSADYADSVKGRFTISRDNSKNTVYLQMNSLRAEDTAVYYCAAEIGYYSGGTYYSSEAHWGQGTLVTVSS |
| IL17MS3011 (IL17MS04G01 variant1) (SEQ ID NO:761) | EVQLVESGGGLVQPGGSLRLSCTASGTIVNIHVMGWYRQAPGKQRELVALIFSGGSADYADSVKGRFTISRDNSKNTVYLQMNSLRAEDTAVYYCAAEIGYYSGGTYYSSEAHWGQGTLVTVSS |
| IL17MS3012 (IL17MS04G01 variant2) (SEQ ID NO:762) | EVQLVESGGGLVQPGGSQRLSCAASGTIVNIHVMGWYRQAPGKQRELVALIFSGGSADYADSVKGRFTISRDNSKNTVYLQMNSLRAEDTAVYYCAAEIGYYSGGTYYSSEAHWGQGTLVTVSS |
| IL17MS3013 (IL17MS04G01 variant3) (SEQ ID NO:763) | EVQLVESGGGLVQPGGSQRLSCTASGTIVNIHVMGWYRQAPGKQRELVALIFSGGSADYADSVKGRFTISRDNSKNTVYLQMNSLRPEDTAVYYCAAEIGYYSGGTYYSSEAHWGQGTLVTVSS |
| IL17MS3014 (IL17MS04G01 variant4) (SEQ ID NO:764) | EVQLVESGGGLVQPGGSLRLSCAASGTIVNIHVMGWYRQAPGKQRELVALIFSGGSADYADSVKGRFTISRDNSKNTVYLQMNSLRAEDTAVYYCAAEIGYYSGGTYYSSEAHWGQGTLVTVSS |
| IL17MS3015 (IL17MS04G01 variant5) (SEQ ID NO:765) | EVQLVESGGGLVQPGGSLRLSCTASGTIVNIHVMGWYRQAPGKQRELVALIFSGGSADYADSVKGRFTISRDNSKNTVYLQMNSLRPEDTAVYYCAAEIGYYSGGTYYSSEAHWGQGTLVTVSS |
| IL17MS3016 (IL17MS04G01 variant6) (SEQ ID NO:766) | EVQLVESGGGLVQPGGSQRLSCAASGTIVNIHVMGWYRQAPGKQRELVALIFSGGSADYADSVKGRFTISRDNSKNTVYLQMNSLRPEDTAVYYCAAEIGYYSGGTYYSSEAHWGQGTLVTVSS |
| IL17MS3017 (IL17MS04G01 variant7) (SEQ ID NO:767) | EVQLVESGGGLVQPGGSLRLSCAASGTIVNIHVMGWYRQAPGKQRELVALIFSGGSADYADSVKGRFTISRDNSKNTVYLQMNSLRPEDTAVYYCAAEIGYYSGGTYYSSEAHWGQGTLVTVSS |
| IL17MS3018 (IL17MS13E02 basic) (SEQ ID NO:768) | EVQLVESGGGLVQPGGSLRLSCAASGRTYDAMGWLRQAPGKEREFVAAISGSGDDTYYADSVKGRFTISKDNSGITMYLQMNSLRPEDTAVYYCATRRGLYYVWDSNDYENWGQGTLVTVSS |
| IL17MS3019 (IL17MS13E02 variant1) (SEQ ID NO:769) | EVQLVESGGGLVQPGGSLRLSCAASGRTYDAMGWFRQAPGKEREFVAAISGSGDDTYYADSVKGRFTISKDNSGITMYLQMNSLRPEDTAVYYCATRRGLYYVWDSNDYENWGQGTLVTVSS |
| IL17MS3020 (IL17MS13E02 variant2) (SEQ ID NO:770) | EVQLVESGGGLVQPGGSLRLSCAASGRTYDAMGWLRQAPGKEREFVAAISGSGDDTYYADSVKGRFTISRDNSGITMYLQMNSLRPEDTAVYYCATRRGLYYVWDSNDYENWGQGTLVTVSS |

*Figure 7 (continued):*

| | |
|---|---|
| IL17MS3021 (IL17MS13E02 variant3) (SEQ ID NO:771) | EVQLVESGGGLVQPGGSLRLSCAASGRTYDAMGWLRQAPGKEREFVAAISGSGDDTYYADSVKGRFTISKDNSKITMYLQMNSLRPEDTAVYYCATRRGLYYVWDSNDYENWGQGTLVTVSS |
| IL17MS3022 (IL17MS13E02 variant4) (SEQ ID NO:772) | EVQLVESGGGLVQPGGSLRLSCAASGRTYDAMGWLRQAPGKEREFVAAISGSGDDTYYADSVKGRFTISKDNSGNTMYLQMNSLRPEDTAVYYCATRRGLYYVWDSNDYENWGQGTLVTVSS |
| IL17MS3023 (IL17MS13E02 variant5) (SEQ ID NO:773) | EVQLVESGGGLVQPGGSLRLSCAASGRTYDAMGWFRQAPGKEREFVAAISGSGDDTYYADSVKGRFTISRDNSGITMYLQMNSLRPEDTAVYYCATRRGLYYVWDSNDYENWGQGTLVTVSS |
| IL17MS3024 (IL17MS13E02 variant6) (SEQ ID NO:774) | EVQLVESGGGLVQPGGSLRLSCAASGRTYDAMGWFRQAPGKEREFVAAISGSGDDTYYADSVKGRFTISKDNSKITMYLQMNSLRPEDTAVYYCATRRGLYYVWDSNDYENWGQGTLVTVSS |
| IL17MS3025 (IL17MS13E02 variant7) (SEQ ID NO:775) | EVQLVESGGGLVQPGGSLRLSCAASGRTYDAMGWFRQAPGKEREFVAAISGSGDDTYYADSVKGRFTISKDNSGNTMYLQMNSLRPEDTAVYYCATRRGLYYVWDSNDYENWGQGTLVTVSS |
| IL17MS3026 (IL17MS13E02 variant8) (SEQ ID NO:776) | EVQLVESGGGLVQPGGSLRLSCAASGRTYDAMGWLRQAPGKEREFVAAISGSGDDTYYADSVKGRFTISRDNSKITMYLQMNSLRPEDTAVYYCATRRGLYYVWDSNDYENWGQGTLVTVSS |
| IL17MS3027 (IL17MS13E02 variant9) (SEQ ID NO:777) | EVQLVESGGGLVQPGGSLRLSCAASGRTYDAMGWLRQAPGKEREFVAAISGSGDDTYYADSVKGRFTISRDNSGNTMYLQMNSLRPEDTAVYYCATRRGLYYVWDSNDYENWGQGTLVTVSS |
| IL17MS3028 (IL17MS13E02 variant10) (SEQ ID NO:778) | EVQLVESGGGLVQPGGSLRLSCAASGRTYDAMGWLRQAPGKEREFVAAISGSGDDTYYADSVKGRFTISKDNSKNTMYLQMNSLRPEDTAVYYCATRRGLYYVWDSNDYENWGQGTLVTVSS |
| IL17MS3029 (IL17MS13E02 variant11) (SEQ ID NO:779) | EVQLVESGGGLVQPGGSLRLSCAASGRTYDAMGWFRQAPGKEREFVAAISGSGDDTYYADSVKGRFTISRDNSKITMYLQMNSLRPEDTAVYYCATRRGLYYVWDSNDYENWGQGTLVTVSS |
| IL17MS3030 (IL17MS13E02 variant12) (SEQ ID NO:780) | EVQLVESGGGLVQPGGSLRLSCAASGRTYDAMGWFRQAPGKEREFVAAISGSGDDTYYADSVKGRFTISKDNSKNTMYLQMNSLRPEDTAVYYCATRRGLYYVWDSNDYENWGQGTLVTVSS |
| IL17MS3031 (IL17MS13E02 variant13) (SEQ ID NO:781) | EVQLVESGGGLVQPGGSLRLSCAASGRTYDAMGWFRQAPGKEREFVAAISGSGDDTYYADSVKGRFTISRDNSGNTMYLQMNSLRPEDTAVYYCATRRGLYYVWDSNDYENWGQGTLVTVSS |

*Figure 7 (continued):*

| | |
|---|---|
| IL17MS3032 (IL17MS13E02 variant14) (SEQ ID NO:782) | EVQLVESGGGLVQPGGSLRLSCAASGRTYDAMGWLRQAPGK EREFVAAISGSGDDTYYADSVKGRFTISRDNSKNTMYLQMNS LRPEDTAVYYCATRRGLYYVWDSNDYENWGQGTLVTVSS |
| IL17MS3033 (IL17MS13E02 variant15) (SEQ ID NO:783) | EVQLVESGGGLVQPGGSLRLSCAASGRTYDAMGWFRQAPGK EREFVAAISGSGDDTYYADSVKGRFTISRDNSKNTMYLQMNS LRPEDTAVYYCATRRGLYYVWDSNDYENWGQGTLVTVSS |
| IL17MS3034 (IL17MS13E02(M34L)) (SEQ ID NO:784) | EVQLVESGGGLVQAGGSLRLSCAASGRTYDALGWLRQAPGK EREFVAAISGSGDDTYYADSVKGRFTISKDNAGITMYLQMNS LKPEDTAVYYCATRRGLYYVWDSNDYENWGQGTQVTVSS |
| IL17MS3035 (IL17MS13E02(M78L)) (SEQ ID NO:785) | EVQLVESGGGLVQAGGSLRLSCAASGRTYDAMGWLRQAPG KEREFVAAISGSGDDTYYADSVKGRFTISKDNAGITLYLQMNS LKPEDTAVYYCATRRGLYYVWDSNDYENWGQGTQVTVSS |
| IL17MS3036 (IL17MS13E02(S100dT)) (SEQ ID NO:786) | EVQLVESGGGLVQAGGSLRLSCAASGRTYDAMGWLRQAPG KEREFVAAISGSGDDTYYADSVKGRFTISKDNAGITMYLQMN SLKPEDTAVYYCATRRGLYYVWDTNDYENWGQGTQVTVSS |
| IL17MS3037 (IL17MS13E02(S100dA)) (SEQ ID NO:787) | EVQLVESGGGLVQAGGSLRLSCAASGRTYDAMGWLRQAPG KEREFVAAISGSGDDTYYADSVKGRFTISKDNAGITMYLQMN SLKPEDTAVYYCATRRGLYYVWDANDYENWGQGTQVTVSS |
| IL17MS3038 (IL17MS013E02(M34V)) (SEQ ID NO:788) | EVQLVESGGGLVQAGGSLRLSCAASGRTYDAVGWLRQAPGK EREFVAAISGSGDDTYYADSVKGRFTISKDNAGITMYLQMNS LKPEDTAVYYCATRRGLYYVWDSNDYENWGQGTQVTVSS |
| IL17MS3039 (IL17MS013E02(M78V)) (SEQ ID NO:789) | EVQLVESGGGLVQAGGSLRLSCAASGRTYDAMGWLRQAPG KEREFVAAISGSGDDTYYADSVKGRFTISKDNAGITVYLQMN SLKPEDTAVYYCATRRGLYYVWDSNDYENWGQGTQVTVSS |
| IL17MS3040 (IL17MS016A04(D55G)) (SEQ ID NO:790) | EVQLVESGGGLVQAGGSLRLSCAASGRTFSSYVVGWFRQAP GKEREFIGAISGSGGSIYYAVSEKDRFTISRDNGKNTLYLQMSS LKAEDTAVYYCTADQEFGYLRFGRSEYWGQGTQVTVSS |
| IL17MS3041 (IL17MS016A04(D55E)) (SEQ ID NO:791) | EVQLVESGGGLVQAGGSLRLSCAASGRTFSSYVVGWFRQAP GKEREFIGAISGSGESIYYAVSEKDRFTISRDNGKNTLYLQMSS LKAEDTAVYYCTADQEFGYLRFGRSEYWGQGTQVTVSS |
| IL17MS3042 (IL17MS016A04(S56T)) (SEQ ID NO:792) | EVQLVESGGGLVQAGGSLRLSCAASGRTFSSYVVGWFRQAP GKEREFIGAISGSGDTIYYAVSEKDRFTISRDNGKNTLYLQMSS LKAEDTAVYYCTADQEFGYLRFGRSEYWGQGTQVTVSS |

*Figure 7 (continued):*

| | |
|---|---|
| IL17MS3043 (IL17MS013B03(A14P,D16G,A74S,D79Y,K83R,Q108L)) (SEQ ID NO:793) | EVQLVESGGGSVQPGGSLRLSCAASGRANSINWFGWFRQTPGKEREFVAGIRWSDAYTEYANSVKGRFTISRDNSKNTVYLQMDSLRPEDTAVYYCVLDLSTVRYWGQGTLVTVSS |
| IL17MS3044 (IL17MS013B03(S11L,A14P,A74S,K83R,Q108L)) (SEQ ID NO:794) | EVQLVESGGGLVQPGDSLRLSCAASGRANSINWFGWFRQTPGKEREFVAGIRWSDAYTEYANSVKGRFTISRDNSKNTVDLQMDSLRPEDTAVYYCVLDLSTVRYWGQGTLVTVSS |
| IL17MS3045 (IL17MS013B03(A14P,T40A,A74S,K83R,Q108L)) (SEQ ID NO:795) | EVQLVESGGGSVQPGDSLRLSCAASGRANSINWFGWFRQAPGKEREFVAGIRWSDAYTEYANSVKGRFTISRDNSKNTVDLQMDSLRPEDTAVYYCVLDLSTVRYWGQGTLVTVSS |
| IL17MS3046 (IL17MS013B03(A14P,N61A,A74S,K83R,Q108L)) (SEQ ID NO:796) | EVQLVESGGGSVQPGDSLRLSCAASGRANSINWFGWFRQTPGKEREFVAGIRWSDAYTEYAASVKGRFTISRDNSKNTVDLQMDSLRPEDTAVYYCVLDLSTVRYWGQGTLVTVSS |
| IL17MS3047 (IL17MS013B03(S11L,A14P,D16G,T40A,N61A,A74S,D79Y,D82aN,K83R,Q108L)) (SEQ ID NO:797) | EVQLVESGGGLVQPGGSLRLSCAASGRANSINWFGWFRQAPGKEREFVAGIRWSDAYTEYAASVKGRFTISRDNSKNTVYLQMNSLRPEDTAVYYCVLDLSTVRYWGQGTLVTVSS |
| IL17MS3048 (IL17MS013B03(A14P,A74S,D82aN,K83R,Q108L)) (SEQ ID NO:798) | EVQLVESGGGSVQPGDSLRLSCAASGRANSINWFGWFRQTPGKEREFVAGIRWSDAYTEYANSVKGRFTISRDNSKNTVDLQMNSLRPEDTAVYYCVLDLSTVRYWGQGTLVTVSS |
| IL17MS3049 (IL17MS013B03(A14P,T40A,A74S,D79Y,K83R,Q108L)) (SEQ ID NO:799) | EVQLVESGGGSVQPGDSLRLSCAASGRANSINWFGWFRQAPGKEREFVAGIRWSDAYTEYANSVKGRFTISRDNSKNTVYLQMDSLRPEDTAVYYCVLDLSTVRYWGQGTLVTVSS |
| IL17MS3050 (IL17MS013B03(A14P,D16G,A74S,K83R,Q108L)) (SEQ ID NO:800) | EVQLVESGGGSVQPGGSLRLSCAASGRANSINWFGWFRQTPGKEREFVAGIRWSDAYTEYANSVKGRFTISRDNSKNTVDLQMDSLRPEDTAVYYCVLDLSTVRYWGQGTLVTVSS |
| IL17MS3051 (IL17MS013B03(N29F)) (SEQ ID NO:801) | EVQLVESGGGSVQAGDSLRLSCAASGRAFSINWFGWFRQTPGKEREFVAGIRWSDAYTEYANSVKGRFTISRDNAKNTVDLQMDSLKPEDTAVYYCVLDLSTVRYWGQGTQVTVSS |

*Figure 7 (continued):*

| | |
|---|---|
| IL17MS3052 (IL17MS013B03(N29S)) (SEQ ID NO:802) | EVQLVESGGGSVQAGDSLRLSCAASGRASSINWFGWFRQTPGKEREFVAGIRWSDAYTEYANSVKGRFTISRDNAKNTVDLQMDSLKPEDTAVYYCVLDLSTVRYWGQGTQVTVSS |
| IL17MS3053 (IL17MS013B03(S30T)) (SEQ ID NO:803) | EVQLVESGGGSVQAGDSLRLSCAASGRANTINWFGWFRQTPGKEREFVAGIRWSDAYTEYANSVKGRFTISRDNAKNTVDLQMDSLKPEDTAVYYCVLDLSTVRYWGQGTQVTVSS |
| IL17MS3054 (IL17MS016A04(A14P,G74S,K83R,A84P,Q108L)) (SEQ ID NO:804) | EVQLVESGGGLVQPGGSLRLSCAASGRTFSSYVVGWFRQAPGKEREFIGAISGSGDSIYYAVSEKDRFTISRDNSKNTLYLQMSSLRPEDTAVYYCTADQEFGYLRFGRSEYWGQGTLVTVSS |
| IL17MS3055 (IL17MS016A04(A14P,D65G,S82aN,K83R,Q108L)) (SEQ ID NO:805) | EVQLVESGGGLVQPGGSLRLSCAASGRTFSSYVVGWFRQAPGKEREFIGAISGSGDSIYYAVSEKGRFTISRDNGKNTLYLQMNSLRAEDTAVYYCTADQEFGYLRFGRSEYWGQGTLVTVSS |
| IL17MS3056 (IL17MS016A04(A14P,I48V,G74S,K83R,Q108L)) (SEQ ID NO:806) | EVQLVESGGGLVQPGGSLRLSCAASGRTFSSYVVGWFRQAPGKEREFVGAISGSGDSIYYAVSEKDRFTISRDNSKNTLYLQMSSLRAEDTAVYYCTADQEFGYLRFGRSEYWGQGTLVTVSS |
| IL17MS3057 (IL17MS13B03 + E1D S11L A14P D16G N29F T40A N61D A74S D79Y D82aN K83R L108Q) (SEQ ID NO:807) | DVQLVESGGGLVQPGGSLRLSCAASGRAFSINWFGWFRQAPGKEREFVAGIRWSDAYTEYADSVKGRFTISRDNSKNTVYLQMNSLRPEDTAVYYCVLDLSTVRYWGQGTLVTVSS |
| IL17MS3058 (IL17MS16A04 + A14P I48V D65G G74S S82aN K83R A84P L108Q) (SEQ ID NO:808) | EVQLVESGGGLVQPGGSLRLSCAASGRTFSSYVVGWFRQAPGKEREFVGAISGSGDSIYYAVSEKGRFTISRDNSKNTLYLQMNSLRPEDTAVYYCTADQEFGYLRFGRSEYWGQGTLVTVSS |
| IL17MS3059 ( IL17MS16A04 + E1D A14P I48V D55E D65G G74S S82aN K83R A84P Q108L) (SEQ ID NO:809) | DVQLVESGGGLVQPGGSLRLSCAASGRTFSSYVVGWFRQAPGKEREFVGAISGSGESIYYAVSEKGRFTISRDNSKNTLYLQMNSLRPEDTAVYYCTADQEFGYLRFGRSEYWGQGTLVTVSS |

*Figure 7 (continued):*

| | |
|---|---|
| IL17MS3060 (IL17MS04G01 + E1D, A14P, Q18L, A74S, E81Q, K83R,A84P, Q108L) (SEQ ID NO:810) | DVQLVESGGGLVQPGGSLRLSCTASGTIVNIHVMGWYRQAPGKQRELVALIFSGGSADYADSVKGRFTISRDNSKNTVYLQMNSLRPEDTAVYYCAAEIGYYSGGTYYSSEAHWGQGTLVTVSS |
| IL17MS3061 (IL17MS04G01 + E1D, A14P, Q18L, T23A, A74S, E81Q, K83R,A84P, Q108L) (SEQ ID NO:811) | DVQLVESGGGLVQPGGSLRLSCAASGTIVNIHVMGWYRQAPGKQRELVALIFSGGSADYADSVKGRFTISRDNSKNTVYLQMNSLRPEDTAVYYCAAEIGYYSGGTYYSSEAHWGQGTLVTVSS |
| IL17MS3062 (IL17MS16A04 + A14P, I48V, D55E, D65G, G74S, S82aN, K83R, A84P, Q108L) (SEQ ID NO:812) | EVQLVESGGGLVQPGGSLRLSCAASGRTFSSYVVGWFRQAPGKEREFVGAISGSGESIYYAVSEKGRFTISRDNSKNTLYLQMNSLRPEDTAVYYCTADQEFGYLRFGRSEYWGQGTLVTVSS |
| IL17MS3063 (C132.IL17MS16A04 + E1D, A14P, D55E, D65G, G74S, S82aN, K83R, A84P, Q108L) (SEQ ID NO:813) | DVQLVESGGGLVQPGGSLRLSCAASGRTFSSYVVGWFRQAPGKEREFIGAISGSGESIYYAVSEKGRFTISRDNSKNTLYLQMNSLRPEDTAVYYCTADQEFGYLRFGRSEYWGQGTLVTVSS |
| IL17MS3064 (C132.IL17MS16A04 + E1D, A14P, I48V, S56T, D65G, G74S, S82aN, K83R, A84P, Q108L) (SEQ ID NO:814) | DVQLVESGGGLVQPGGSLRLSCAASGRTFSSYVVGWFRQAPGKEREFVGAISGSGDTIYYAVSEKGRFTISRDNSKNTLYLQMNSLRPEDTAVYYCTADQEFGYLRFGRSEYWGQGTLVTVSS |
| IL17MS3065 (IL17MS16A04 + E1D, A14P, S56T, D65G, G74S, S82aN, K83R, A84P, Q108L) (SEQ ID NO:815) | DVQLVESGGGLVQPGGSLRLSCAASGRTFSSYVVGWFRQAPGKEREFIGAISGSGDTIYYAVSEKGRFTISRDNSKNTLYLQMNSLRPEDTAVYYCTADQEFGYLRFGRSEYWGQGTLVTVSS |
| IL17MS3066 (IL17MS13B03 + E1D, S11L, A14P, D16G, N29S, T40A, N61D, A74S, D79Y, D82aN, K83R, Q108L) (SEQ ID NO:816) | DVQLVESGGGLVQPGGSLRLSCAASGRASSINWFGWFRQAPGKEREFVAGIRWSDAYTEYADSVKGRFTISRDNSKNTVYLQMNSLRPEDTAVYYCVLDLSTVRYWGQGTLVTVSS |

*Figure 7 (continued):*

| | |
|---|---|
| IL17MS3067 (IL17MS13B03 + E1D, S11L, A14P, D16G, N29S, F34M, T40A, N61D, A74S, D79Y, D82aN, K83R, Q108L) (SEQ ID NO:817) | DVQLVESGGGLVQPGGSLRLSCAASGRASSINWMGWFRQAPGKEREFVAGIRWSDAYTEYADSVKGRFTISRDNSKNTVYLQMNSLRPEDTAVYYCVLDLSTVRYWGQGTLVTVSS |
| IL17MS3068 (IL17MS13B03 + S11L, A14P, D16G, N29S, F34M, T40A, N61D, A74S, D79Y, D82aN, K83R, Q108L) (SEQ ID NO:818) | EVQLVESGGGLVQPGGSLRLSCAASGRASSINWMGWFRQAPGKEREFVAGIRWSDAYTEYADSVKGRFTISRDNSKNTVYLQMNSLRPEDTAVYYCVLDLSTVRYWGQGTLVTVSS |
| IL17MS3069 (IL17MS13E02 + A14P, K71R, A74S, G75K, I76N, M78L, K83R, S100dA, Q108L) (SEQ ID NO:819) | EVQLVESGGGLVQPGGSLRLSCAASGRTYDAMGWLRQAPGKEREFVAAISGSGDDTYYADSVKGRFTISRDNSKNTLYLQMNSLRPEDTAVYYCATRRGLYYVWDANDYENWGQGTLVTVSS |
| IL17MS3070 (IL17MS13E02 + E1D, A14P, K71R, A74S, G75K, I76N, M78L, K83R, S100dA, Q108L) (SEQ ID NO:820) | DVQLVESGGGLVQPGGSLRLSCAASGRTYDAMGWLRQAPGKEREFVAAISGSGDDTYYADSVKGRFTISRDNSKNTLYLQMNSLRPEDTAVYYCATRRGLYYVWDANDYENWGQGTLVTVSS |
| IL17MS3071 (IL17MS13E02 + A14P, M34L, K71R, A74S, G75K, I76N, M78L, K83R, S100dA, Q108L) (SEQ ID NO:821) | EVQLVESGGGLVQPGGSLRLSCAASGRTYDALGWLRQAPGKEREFVAAISGSGDDTYYADSVKGRFTISRDNSKNTLYLQMNSLRPEDTAVYYCATRRGLYYVWDANDYENWGQGTLVTVSS |
| IL17MS3072 (IL17MS13E02 + E1D, A14P, M34L, K71R, A74S, G75K, I76N, M78L, K83R, S100dA, Q108L) (SEQ ID NO:822) | DVQLVESGGGLVQPGGSLRLSCAASGRTYDALGWLRQAPGKEREFVAAISGSGDDTYYADSVKGRFTISRDNSKNTLYLQMNSLRPEDTAVYYCATRRGLYYVWDANDYENWGQGTLVTVSS |

*Figure 7 (continued):*

| | |
|---|---|
| IL17MS3073 (C132.IL17MS04G01 + E1D, A14P, Q18L, E81Q, K83R, A84P, Q108L) (SEQ ID NO:823) | DVQLVESGGGLVQPGGSLRLSCTASGTIVNIHVMGWYRQAPGKQRELVALIFSGGSADYADSVKGRFTISRDNAKNTVYLQMNSLRPEDTAVYYCAAEIGYYSGGTYYSSEAHWGQGTLVTVSS |
| IL17MS3074 (IL17MS04G01 + E1D, A14P, Q18L, T23A, E81Q, K83R, A84P, Q108L) (SEQ ID NO:824) | DVQLVESGGGLVQPGGSLRLSCAASGTIVNIHVMGWYRQAPGKQRELVALIFSGGSADYADSVKGRFTISRDNAKNTVYLQMNSLRPEDTAVYYCAAEIGYYSGGTYYSSEAHWGQGTLVTVSS |
| IL17MS3075 (IL17MS13B03 + E1D, S11L, A14P, D16G, N29S, F34M, T40A, N61D, D79Y, D82aN, K83R, Q108L) (SEQ ID NO:825) | DVQLVESGGGLVQPGGSLRLSCAASGRASSINWMGWFRQAPGKEREFVAGIRWSDAYTEYADSVKGRFTISRDNAKNTVYLQMNSLRPEDTAVYYCVLDLSTVRYWGQGTLVTVSS |

*Figure 8:*

| | |
|---|---|
| IL17MS3076 (SEQ ID NO:826) | DVQLVESGGGLVQPGGSLRLSCAASGRTYDAMGWLRQAPGKEREFVAAISGSGDDTYYADSVKGRFTISRDNSKNTLYLQMNSLRPEDTAVYYCATRRGLYYVWDANDYENWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGRASSINWMGWFRQAPGKEREFVAGIRWSDAYTEYADSVKGRFTISRDNSKNTVYLQMNSLRPEDTAVYYCVLDLSTVRYWGQGTLVTVSS |
| IL17MS3077 (SEQ ID NO:827) | DVQLVESGGGLVQPGGSLRLSCAASGRASSINWMGWFRQAPGKEREFVAGIRWSDAYTEYADSVKGRFTISRDNSKNTVYLQMNSLRPEDTAVYYCVLDLSTVRYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGRTYDAMGWLRQAPGKEREFVAAISGSGDDTYYADSVKGRFTISRDNSKNTLYLQMNSLRPEDTAVYYCATRRGLYYVWDANDYENWGQGTLVTVSS |
| IL17MS3078 (SEQ ID NO:828) | DVQLVESGGGLVQPGGSLRLSCAASGRTYDAMGWLRQAPGKEREFVAAISGSGDDTYYADSVKGRFTISRDNSKNTLYLQMNSLRPEDTAVYYCATRRGLYYVWDANDYENWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGRTYDAMGWLRQAPGKEREFVAAISGSGDDTYYADSVKGRFTISRDNSKNTLYLQMNSLRPEDTAVYYCATRRGLYYVWDANDYENWGQGTLVTVSS |
| IL17MS3079 (SEQ ID NO:829) | DVQLVESGGGLVQPGGSLRLSCAASGRASSINWMGWFRQAPGKEREFVAGIRWSDAYTEYADSVKGRFTISRDNSKNTVYLQMNSLRPEDTAVYYCVLDLSTVRYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGRASSINWMGWFRQAPGKEREFVAGIRWSDAYTEYADSVKGRFTISRDNSKNTVYLQMNSLRPEDTAVYYCVLDLSTVRYWGQGTLVTVSS |
| IL17MS3080 (SEQ ID NO:830) | DVQLVESGGGLVQPGGSLRLSCTASGTIVNIHVMGWYRQAPGKQRELVALIFSGGSADYADSVKGRFTISRDNSKNTVYLQMNSLRPEDTAVYYCAAEIGYYSGGTYYSSEAHWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |
| IL17MS3081 (SEQ ID NO:831) | DVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCTASGTIVNIHVMGWYRQAPGKQRELVALIFSGGSADYADSVKGRFTISRDNSKNTVYLQMNSLRPEDTAVYYCAAEIGYYSGGTYYSSEAHWGQGTLVTVSS |

*Figure 8 (continued):*

| | |
|---|---|
| IL17MS3082 (SEQ ID NO:832) | DVQLVESGGGLVQPGGSLRLSCTASGTIVNIHVMGWYRQAPGKQRELVALIFSGGSADYADSVKGRFTISRDNSKNTVYLQMNSLRPEDTAVYYCAAEIGYYSGGTYYSSEAHWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGRTFSSYVVGWFRQAPGKEREFIGAISGSGESIYYAVSEKGRFTISRDNSKNTLYLQMNSLRPEDTAVYYCTADQEFGYLRFGRSEYWGQGTLVTVSS |
| IL17MS3083 (SEQ ID NO:833) | DVQLVESGGGLVQPGGSLRLSCAASGRTFSSYVVGWFRQAPGKEREFIGAISGSGESIYYAVSEKGRFTISRDNSKNTLYLQMNSLRPEDTAVYYCTADQEFGYLRFGRSEYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCTASGTIVNIHVMGWYRQAPGKQRELVALIFSGGSADYADSVKGRFTISRDNSKNTVYLQMNSLRPEDTAVYYCAAEIGYYSGGTYYSSEAHWGQGTLVTVSS |
| IL17MS3084 (SEQ ID NO:834) | DVQLVESGGGLVQPGGSLRLSCAASGRTFSSYVVGWFRQAPGKEREFIGAISGSGESIYYAVSEKGRFTISRDNSKNTLYLQMNSLRPEDTAVYYCTADQEFGYLRFGRSEYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGRASSINWMGWFRQAPGKEREFVAGIRWSDAYTEYADSVKGRFTISRDNSKNTVYLQMNSLRPEDTAVYYCVLDLSTVRYWGQGTLVTVSS |
| IL17MS3085 (SEQ ID NO:835) | DVQLVESGGGLVQPGGSLRLSCAASGRASSINWMGWFRQAPGKEREFVAGIRWSDAYTEYADSVKGRFTISRDNSKNTVYLQMNSLRPEDTAVYYCVLDLSTVRYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGRTFSSYVVGWFRQAPGKEREFIGAISGSGESIYYAVSEKGRFTISRDNSKNTLYLQMNSLRPEDTAVYYCTADQEFGYLRFGRSEYWGQGTLVTVSS |
| IL17MS3086 (SEQ ID NO:836) | DVQLVESGGGLVQPGGSLRLSCAASGRTFSSYVVGWFRQAPGKEREFIGAISGSGESIYYAVSEKGRFTISRDNSKNTLYLQMNSLRPEDTAVYYCTADQEFGYLRFGRSEYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGRTYDAMGWLRQAPGKEREFVAAISGSGDDTYYADSVKGRFTISRDNSKNTLYLQMNSLRPEDTAVYYCATRRGLYYVWDANDYENWGQGTLVTVSS |

*Figure 8 (continued):*

| | |
|---|---|
| IL17MS3087 (SEQ ID NO:837) | DVQLVESGGGLVQPGGSLRLSCAASGRTYDAMGWLRQAPGKEREFVAAISGSGDDTYYADSVKGRFTISRDNSKNTLYLQMNSLRPEDTAVYYCATRRGLYYVWDANDYENWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGRTFSSYVVGWFRQAPGKEREFIGAISGSGESIYYAVSEKGRFTISRDNSKNTLYLQMNSLRPEDTAVYYCTADQEFGYLRFGRSEYWGQGTLVTVSS |
| IL17MS3091 - a Myc-HIS tagged variant (SEQ ID NO: 838) | DVQLVESGGGLVQPGGSLRLSCAASGRTFSSYVVGWFRQAPGKEREFIGAISGSGESIYYAVSEKGRFTISRDNSKNTLYLQMNSLRPEDTAVYYCTADQEFGYLRFGRSEYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGRTYDAMGWLRQAPGKEREFVAAISGSGDDTYYADSVKGRFTISRDNSKNTLYLQMNSLRPEDTAVYYCATRRGLYYVWDANDYENWGQGTLVTVSSGAAEQKLISEEDLNGAAHHHHHH |

*Figure 9:*

| | |
|---|---|
| **Human IL-17A-6His** (SEQ ID NO:694) | GITIPRNPGCPNSEDKNFPRTVMVNLNIHNRNTNTNPKRSSDYYNRST SPWNLHRNEDPERYPSVIWEAKCRHLGCINADGNVDYHMNSVPIQQ EILVLRREPPHCPNSFRLEKILVSVGCTCVTPIVHHVAHHHHHH |
| **Human IL-17F-6His** (SEQ ID NO:695) | RKIPKVGHTFFQKPESCPPVPGGSMKLDIGIINENQRVSMSRNIESRST SPWNYTVTWDPNRYPSEVVQAQCRNLGCINAQGKEDISMNSVPIQQ ETLVVRRKHQGCSVSFQLEKVLVTVGCTCVTPVIHHVQHHHHHH |
| **Cynomolgus IL-17A-6His** (SEQ ID NO:696) | GIAIPRNSGCPNSEDKNFPRTVMVNLNIHNRNTSTNPKRSSDYYNRST SPWNLHRNEDPERYPSVIWEAKCRHLGCVKADGNVDYHMNSVPIQQ EILVLRREPRHCPNSFRLEKILVSVGCTCVTPIVHHVAHHHHHH |
| **Cynomolgus IL-17F-6His** (SEQ ID NO:697) | RKIPKVGHTFFQKPESCPPVPEGSMKLDTGIINENQRVSMSRNIESRST SPWNYTVTWDPNRYPSEVVQAQCKHLGCINAQGKEDISMNSVPIQQ ETLVLRRKHQGCSVSFQLEKVLVTVGCTCVTPVIHHVQHHHHHH |
| **Marmoset IL-17A-6His** (SEQ ID NO:698) | SPQNPGCPNAEDKNFPRTVMVNLNIRNRNTNSKRASDYYNRSSSPW NLHRNEDPERYPSVIWEAKCRHLGCVDADGNVDYHMNSVPIQQEIL VLRREPRHCTNSFRLEKMLVSVGCTCVTPIVRHVAHHHHHH |
| **Marmoset IL-17F-6His** (SEQ ID NO:699) | QRVPKEGQTFFQKPESCPSVPEGSLKLDLGIINANQRVPLSRNIERRST SPWNYTVTWDPNRYPSEVVQAQCRHLGCVNAQGKEDIFMNSVPIQQ ETLVLRRKHQGCSVSFQLEKLLVTVGCTCVKPLIHHVHHHHHH |
| **Guinea pig IL-17A-6His** (SEQ ID NO:700) | GIPIPRNPGCPTATEGKNFLQNVKLNLSIFNPLTQNVNSRRSSDYYKRS TSPWTLHRNENPNRYPPVIWEAECRYSGCVNAAGKEDHHVSSVPIQQ EILVLQREPQNCPLSFRLEKMKVTVGCTCVTPIVRHVGHHHHHH |
| **Rat IL-17F-6His** (SEQ ID NO:701) | RRNPKVGLSALQKAGNCPPLEDNSVRVDIRIFNQNQGISVPRDFQNRS SSPWDYNITRDPDRFPSEIAEAQCRHSGCINAQGQEDGSMNSVPIQQE ILVLRREPQGCSNSFRLEKMLIKVGCTCVTPIVHHAAHHHHHH |
| **Mouse IL-17A-6His** (SEQ ID NO:702) | AIIPQSSACPNTEAKDFLQNVKVNLKVFNSLGAKVSSRRPSDYLNRST SPWTLHRNEDPDRYPSVIWEAQCRHQRCVNAEGKLDHHMNSVLIQQ EILVLKREPESCPFTFRVEKMLVGVGCTCVASIVRQAAHHHHHH |
| **Mouse IL-17F-6His** (SEQ ID NO:703) | RKNPKAGVPALQKAGNCPPLEDNTVRVDIRIFNQNQGISVPREFQNR SSSPWDYNITRDPHRFPSEIAEAQCRHSGCINAQGQEDSTMNSVAIQQ EILVLRREPQGCSNSFRLEKMLLKVGCTCVKPIVHQAAHHHHHH |
| **Fab01-6His, light chain** (SEQ ID NO:704) | EIVLTQSPGTLSLSPGERATLSCRASQSVSSSYLAWYQQKPGQAPRLL IYGASSRATGIPDRFSGSGSGTDFTLTISRLEPEDFAVYYCQQYGSSPC TFGQGTRLEIKRTVAAPSVFIFPPSDEQLKSGTASVVCLLNNFYPREA KVQWKVDNALQSGNSQESVTEQDSKDSTYSLSSTLTLSKADYEKHK VYACEVTHQGLSSPVTKSFNRGEC |
| **Fab01-6His, heavy chain** (SEQ ID NO:705) | EVQLVESGGGLVQPGGSLRLSCAASGFTFSNYWMNWVRQAPGKGL EWVAAINQDGSEKYYVGSVKGRFTISRDNAKNSLYLQMNSLRVEDT AVYYCVRDYYDILTDYYIHYWYFDLWGRGTLVTVSSASTKGPSVFP LAPSSKSTSGGTAALGCLVKDYFPEPVTVSWNSGALTSGVHTFPAVL QSSGLYSLSSVVTVPSSSLGTQTYICNVNHKPSNTKVDKRVEPKSCDK THHHHHH |
| **mAb02, light chain** (SEQ ID NO:706) | EIVLTQSPGTLSLSPGERATLSCRASQSVSSSYLAWYQQKPGQAPRLL IYGASSRATGIPDRFSGSGSGTDFTLTISRLEPEDFAVYYCQQYGSSPC TFGQGTRLEIKRTVAAPSVFIFPPSDEQLKSGTASVVCLLNNFYPREA KVQWKVDNALQSGNSQESVTEQDSKDSTYSLSSTLTLSKADYEKHK VYACEVTHQGLSSPVTKSFNRGEC |

*Figure 9 (continued):*

| | |
|---|---|
| **mAb02, heavy chain** (SEQ ID NO:707) | EVQLVESGGGLVQPGGSLRLSCAASGFTFSNYWMNWVRQAPGKGL EWVAAINQDGSEKYYVGSVKGRFTISRDNAKNSLYLQMNSLRVEDT AVYYCVRDYYDILTDYYIHYWYFDLWGRGTLVTVSSASTKGPSVFP LAPSSKSTSGGTAALGCLVKDYFPEPVTVSWNSGALTSGVHTFPAVL QSSGLYSLSSVVTVPSSSLGTQTYICNVNHKPSNTKVDKRVEPKSCDK THTCPPCPAPELLGGPSVFLFPPKPKDTLMISRTPEVTCVVVDVSHED PEVKFNWYVDGVEVHNAKTKPREEQYNSTYRVVSVLTVLHQDWLN GKEYKCKVSNKALPAPIEKTISKAKGQPREPQVYTLPPSREEMTKNQ VSLTCLVKGFYPSDIAVEWESNGQPENNYKTTPPVLDSDGSFFLYSKL TVDKSRWQQGNVFSCSVMHEALHNHYTQKSLSLSPGK |

Figure 12
A
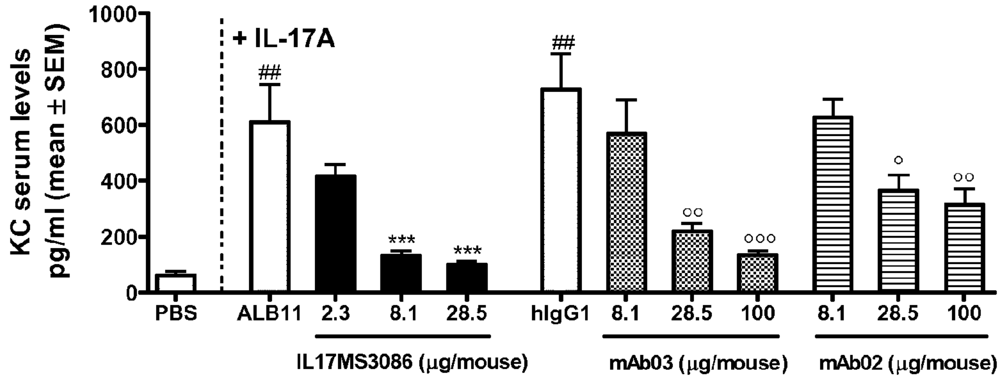
## p<0.01 vs PBS
*** p<0.001 vs ALB11
°°° p<0.001; °° p<0.01; ° p<0.05 vs hIgG1
B
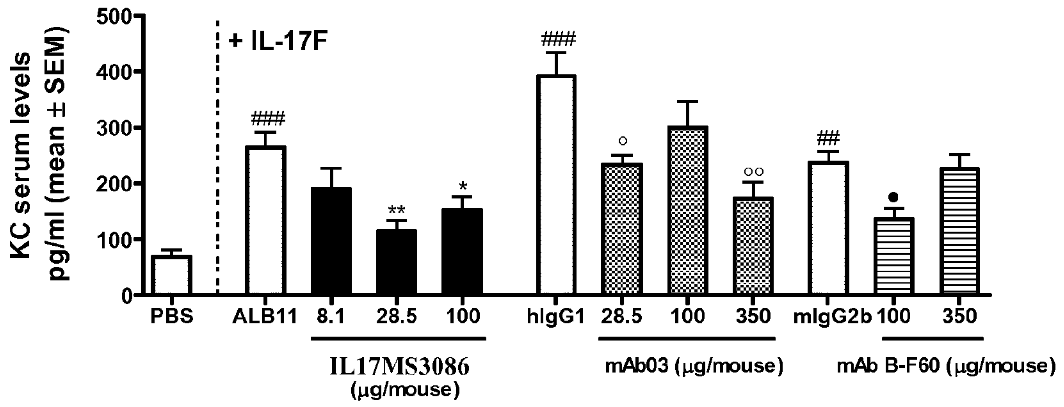
### p<0.001; ## p<0.01 vs PBS
** p<0.01; * p<0.05 vs ALB11
°°p<0.01; ° p<0.05 vs hIgG1
• p<0.05 vs mIgG2b Figure 16
A
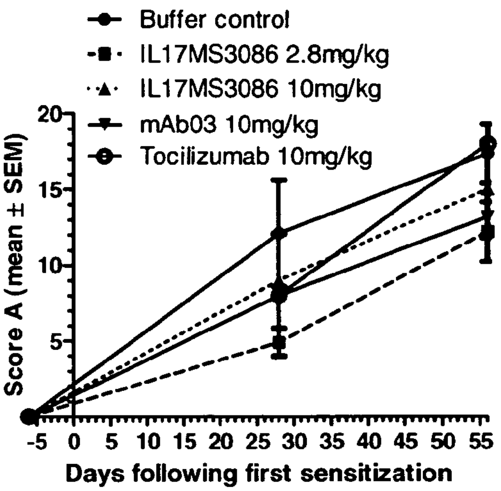
B
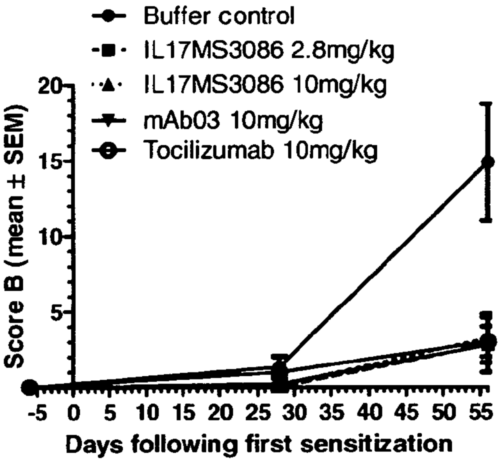

POLYPEPTIDES THAT BIND TO IL-17A, IL-17F AND/OR IL17-A/F AND METHOD OF TREATMENT USING SAME

CROSS-REFERENCE TO RELATED APPLICATIONS

This application is the National Phase of International Patent Application No. PCT/EP2012/058313, filed May 4, 2012, published as WO 2012/156219, which claims priority to U.S. Provisional Application No. 61/482,802, filed May 5, 2011. The contents of these applications are herein incorporated by reference in their entirety.

SEQUENCE LISTING

The instant application contains a Sequence Listing which has been submitted electronically in ASCII format and is hereby incorporated by reference in its entirety. Said ASCII copy, created on Feb. 12, 2014, is named 103926-0200_SL.txt and is 676,342 bytes in size.

The present invention relates to amino acid sequences that are directed against (as defined herein) any of IL-17A, IL-17F and/or IL-17A/F including combinations thereof, as well as to compounds or constructs, and in particular proteins and polypeptides, that comprise or essentially consist of one or more such amino acid sequences (also referred to herein as "amino acid sequences of the invention", "compounds of the invention", and "polypeptides of the invention", respectively).

As further described herein, preferably, the amino acid sequences of the invention are immunoglobulin single variable domains ("ISV's"). An immunoglobulin single variable domain is an amino acid sequence that:

comprises an immunoglobulin fold or that, under suitable conditions (such as physiological conditions) is capable of forming an immunoglobulin fold (i.e. by folding), i.e. so as to form an immunoglobulin variable domain (such as, for example, a VH, VL or VHH domain);

and that forms (or under such suitable conditions is capable of forming) an immunoglobulin variable domain that comprises a functional antigen binding activity (in the sense that it does not require an interaction with another immunoglobulin variable domain (such as a VH-VL interaction) to form a functional antigen binding site).

Amino acid sequences of the invention that are ISV's are also referred to herein as "ISV's of the invention". Some preferred examples of immunoglobulin single variable domains suitable for use in the invention will become clear from the further description herein, and for example comprise VHH's and/or (other) Nanobodies (preferred), such as humanized VHH's or camelized VH's, such as camelized human VH, dAb's and (single) domain antibodies.

The invention also relates to nucleic acids encoding such amino acid sequences and polypeptides (also referred to herein as "nucleic acids of the invention" or "nucleotide sequences of the invention"); to methods for preparing such amino acid sequences and polypeptides; to host cells expressing or capable of expressing such amino acid sequences or polypeptides; to compositions, and in particular to pharmaceutical compositions, that comprise such amino acid sequences, polypeptides, nucleic acids and/or host cells; and to uses of such amino acid sequences or polypeptides, nucleic acids, host cells and/or compositions, in particular for prophylactic, therapeutic or diagnostic purposes, such as the prophylactic, therapeutic or diagnostic purposes mentioned herein.

Other aspects, embodiments, advantages and applications of the invention will become clear from the further description herein. Several documents are cited throughout the text of this specification. Each of the documents cited herein (including all patents, patent applications, scientific publications, manufacturer's specifications, instructions, etc.), whether supra or infra, are hereby incorporated by reference in their entirety. Nothing herein is to be construed as an admission that the invention is not entitled to antedate such disclosure by virtue of prior invention.

Interleukin-17A (IL-17A also referred to as IL-17 in the literature) is a T-cell derived pro-inflammatory molecule that stimulates epithelial, endothelial and fibroblastic cells to produce other inflammatory cytokines and chemokines including IL-6, IL-8, G-CSF, and MCP-1 [see, Yao, Z. et al., J. Immunol., 122 (12): 5483-5486 (1995); Yao, Z. et al., Immunity, 3 (6): 811-821 (1995); Fossiez, F., et al., J. Exp. Med., 183 (6): 2593-2603 (1996); Kennedy, J., et al., J. Interferon Cytokine Res., 16 (8): 611-7 (1996); Cai, X. Y., et al., Immunol. Lett, 62 (1): 51-8 (1998); Jovanovic, D. V., et al., J. Immunol., 160 (7): 3513-21 (1998); Laan, M., et al., J. Immunol. 162 (4): 2347-52 (1999); Linden, A., et al, Eur Respir J, 15 (5): 973-7 (2000); and Aggarwal, S. and Gurney, A. L., J Leukoc Biol, 71 (1): 1-8 (2002)]. IL-17A also synergizes with other cytokines including TNF-α and IL-1β to further induce chemokine expression (Chabaud, M., et al., J. Immunol. 161 (1): 409-14 (1998)). IL-17A exhibits pleitropic biological activities on various types of cells. IL-17A also has the ability to induce ICAM-1 surface expression, proliferation of T cells, and growth and differentiation of CD34+ human progenitors into neutrophils. IL-17A has also been implicated in bone metabolism, and has been suggested to play an important role in pathological conditions characterized by the presence of activated T cells and TNF-α production such as rheumatoid arthritis and loosening of bone implants (Van Bezooijen et al., J. Bone Miner. Res., 14: 1513-1521 [1999]). Activated T cells of synovial tissue derived from rheumatoid arthritis patients were found to secrete higher amounts of IL-17A than those derived from normal individuals or osteoarthritis patients (Chabaud et al., Arthritis Rheum., 42: 963-970 [1999]). It was suggested that this proinflammatory cytokine actively contributes to synovial inflammation in rheumatoid arthritis. Apart from its proinflammatory role, IL-17A seems to contribute to the pathology of rheumatoid arthritis by yet another mechanism. For example, IL-17A has been shown to induce the expression of osteoclast differentiation factor (ODF) mRNA in osteoblasts (Kotake et al., J. Clin. Invest., 103: 1345-1352 [1999]). ODF stimulates differentiation of progenitor cells into osteoclasts, the cells involved in bone resorption. Since the level of IL-17A is significantly increased in synovial fluid of rheumatoid arthritis patients, it appears that IL-17A induced osteoclast formation plays a crucial role in bone resorption in rheumatoid arthritis. IL-17A is also believed to play a key role in certain other autoimmune disorders such as multiple sclerosis (Matusevicius et al., Mult. Scler., 5: 101-104 (1999); Kurasawa, K., et al., Arthritis Rheu 43 (11): 2455-63 (2000)) and psoriasis (Teunissen, M. B., et al., J Invest Dermatol 1 11 (4): 645-9 (1998); Albanesi, C., et al., J Invest Dermatol 115 (1): 81-7 (2000); and Homey, B., et al., J. Immunol. 164 (12: 6621-32 (2000)).

IL-17A has further been shown, by intracellular signalling, to stimulate Ca2+ influx and a reduction in [cAMP] in human macrophages (Jovanovic et al., J. Immunol., 160:

3513 [1998]). IL-17A induces the activation of NF-KB in fibroblasts, [Yao et al., Immunity, 3: 811 (1995), Jovanovic et al., supra], while it induces the activation of NF-κB and mitogen-activated protein kinases in macrophages (Shalom-Barek et al., J. Biol. Chem., 273: 27467 [1998]). Additionally, IL-17A also shares sequence similarity with mammalian cytokine-like factor 7 that is involved in bone and cartilage growth.

Interleukin 17A is now recognized as the prototype member of an emerging family of cytokines (see review by Gaffen, 2009 Nature Review Immunology 9:556-567). The large scale sequencing of the human and other vertebrate genomes has revealed the presence of additional genes encoding proteins clearly related to IL-17A, thus defining a new family of cytokines. There are at least 6 members of the IL-17 family in humans and mice including IL-17B, IL-17C, IL-17D, IL-17E and IL-17F as well as 6 related receptors IL-17RA, IL-17RB, IL-17RC (also known as IL-17 RL), IL-17RD and IL-17RF (Gaffen ibid.). One such IL-17 member (designated as IL-17F) has been demonstrated to bind to the human IL-17 receptor (IL-17R) (Yao et al., Cytokine, 9 (11): 794-800 (1997)). Initial characterization suggests that, like IL-17A, several of these newly identified molecules have the ability to modulate immune function. The potent inflammatory actions that have been identified for several of these factors and the emerging associations with major human diseases suggest that these proteins may have significant roles in inflammatory processes and may offer opportunities for therapeutic intervention.

The gene encoding human IL-17F is located adjacent to that encoding IL-17A (Hymowitz, S. G., et al., Embo J, 20 (19): 5332-41 (2001)). IL-17A and IL-17F share about 50% amino acid identity whereas the other members of the IL-17 family share a more limited 15-27% amino acid identity, suggesting that IL-17A and IL-17F form a distinct subgroup within the IL-17 family (Starnes et al., J Immunol, 167 (8): 4137-40 (2001); Aggarwal and Gurney J. Leukoc Biol, 71 (1): 1-8 (2002)). IL-17F appears to have similar biological actions as IL-17A, and is able to promote the production of IL-6, IL-8, and G-CSF from a wide variety of cells. Similar to IL-17A, it is able to induce cartilage matrix release and inhibit new cartilage matrix synthesis (see US-2002-0177188-A1 published Nov. 28, 2002). Thus, like IL-17A, IL-17F may potentially contribute to the pathology of inflammatory disorders.

Recently, it has been observed that both IL-17A and IL-17F are induced in T cells by the action of interleukin 23 (IL-23) (Aggarwal et al., J. Biol. Chem., 278 (3): 1910-4 (2003)). The observation that IL-17A and IL-17F share similar chromosomal localization and significant sequence similarity as well as the observation that IL-17A and IL-17F appear to be induced with the same cell population in response to a specific stimuli has lead to the identification of a new human cytokine that is comprised of a covalent (via 2 disulfide bonds) heterodimer of IL-17A and IL-17F (herein designated IL-17A/F), see also WO05/010044, Wright et al., J. Biol. Chem., 282: 13447 (2007); Kawaguchi et al., J. Allergy Clin. Immunol., 114: 1265 (2004); and Kolls, J K et al., Immunity, 21: 467 (2004).

The amino acid sequences, polypeptides and compositions of the present invention can generally be used to modulate, and in particular inhibit and/or prevent, binding of any of IL-17A, IL-17F and/or IL-17A/F including combinations thereof to IL-17RA and/or IL-17RC complex, and thus to modulate, and in particular inhibit or prevent, the signalling that is mediated by the binding of any of IL-17A, IL-17F and/or IL-17A/F including combinations thereof to IL-17RA and/or IL-17RC complex, to modulate the biological pathways in which the binding of any of IL-17A, IL-17F and/or IL-17A/F including combinations thereof to IL-17RA and/or IL-17RC complex is involved, and/or to modulate the biological mechanisms, responses and effects associated with such signalling or these pathways. Although the stochiometry is not definitely determined of the IL-17 receptor complex, it is believed that IL-17A, IL-17F and IL-17A/F signal via dimers and/or trimers of IL-17RA and/or IL-17RC (Gaffen ibid.).

As such, the amino acid sequences, polypeptides and compositions of the present invention can be used for the prevention and treatment (as defined herein) of immune related diseases and disorders (herein referred to as 'immune related diseases and disorders of the invention'). Generally, the "immune related diseases and disorders of the invention" can be defined as diseases and disorders that can be prevented and/or treated, respectively, by suitably administering to a subject in need thereof (i.e. having the disease or disorder or at least one symptom thereof and/or at risk of attracting or developing the disease or disorder) of either a polypeptide or composition of the invention (and in particular, of a pharmaceutically active amount thereof) and/or of a known active principle active against any of IL-17A, IL-17F and/or IL-17A/F including combinations thereof or a biological pathway or mechanism in which any of IL-17A, IL-17F and/or IL-17A/F including combinations thereof is involved (and in particular, of a pharmaceutically active amount thereof). Examples of such immune related diseases and disorders of the invention will be clear to the skilled person based on the disclosure herein, and for example include the following diseases and disorders: systemic lupus erythematosus, rheumatoid arthritis, osteoarthritis, juvenile chronic arthritis, spondyloarthropathies, systemic sclerosis, idiopathic inflammatory myopathies, Sjögren's syndrome, systemic vasculitis, sarcoidosis, autoimmune hemolytic anemia, autoimmune thrombocytopenia, thyroiditis, diabetes mellitus, immune-mediated renal disease, demyelinating diseases of the central and peripheral nervous systems such as multiple sclerosis, idiopathic demyelinating polyneuropathy or Guillain-Barre syndrome, and chronic inflammatory demyelinating polyneuropathy, hepatobiliary diseases such as infectious, autoimmune chronic active hepatitis, primary biliary cirrhosis, granulomatous hepatitis, and sclerosing cholangitis, inflammatory bowel disease, gluten-sensitive enteropathy, and Whipple's disease, autoimmune or immune-mediated skin diseases including bullous skin diseases, erythema multiforme and contact dermatitis, psoriasis, allergic diseases such as asthma, allergic rhinitis, atopic dermatitis, food hypersensitivity and urticaria, immunologic diseases of the lung such as eosinophilic pneumonia, idiopathic pulmonary fibrosis and hypersensitivity pneumonitis, transplantation associated diseases including graft rejection and graft-versus-host-disease.

In particular, the amino acid sequences, polypeptides and compositions of the present invention can be used for the prevention and treatment of immune related diseases and disorders of the invention which are characterized by excessive and/or unwanted signalling mediated by any of IL-17A, IL-17F and/or IL-17A/F including combinations thereof or by the pathway(s) in which any of IL-17A, IL-17F and/or IL-17A/F including combinations thereof is involved. Examples of such immune related diseases and disorders of the invention will again be clear to the skilled person based on the disclosure herein.

Thus, without being limited thereto, the amino acid sequences and polypeptides of the invention can for example be used to prevent and/or to treat all diseases and disorders that are currently being prevented or treated with active principles that can modulate any of IL-17A, IL-17F and/or IL-17A/F including combinations thereof-mediated signalling, such as those mentioned in the prior art cited above. It is also envisaged that the polypeptides of the invention can be used to prevent and/or to treat all diseases and disorders for which treatment with such active principles is currently being developed, has been proposed, or will be proposed or developed in future. In addition, it is envisaged that, because of their favourable properties as further described herein, the polypeptides of the present invention may be used for the prevention and treatment of other diseases and disorders than those for which these known active principles are being used or will be proposed or developed; and/or that the polypeptides of the present invention may provide new methods and regimens for treating the diseases and disorders described herein.

Other applications and uses of the amino acid sequences and polypeptides of the invention will become clear to the skilled person from the further disclosure herein.

Generally, it is an object of the invention to provide pharmacologically active agents, as well as compositions comprising the same, that can be used in the diagnosis, prevention and/or treatment of immune related diseases and disorders of the invention and of the further diseases and disorders mentioned herein; and to provide methods for the diagnosis, prevention and/or treatment of such diseases and disorders that involve the administration and/or use of such agents and compositions.

In particular, it is an object of the invention to provide such pharmacologically active agents, compositions and/or methods that have certain advantages compared to the agents, compositions and/or methods that are currently used and/or known in the art. These advantages will become clear from the further description below.

More in particular, it is an object of the invention to provide therapeutic proteins that can be used as pharmacologically active agents, as well as compositions comprising the same, for the diagnosis, prevention and/or treatment of immune related diseases and disorders of the invention and of the further diseases and disorders mentioned herein; and to provide methods for the diagnosis, prevention and/or treatment of such diseases and disorders that involve the administration and/or the use of such therapeutic proteins and compositions.

Accordingly, it is a specific object of the present invention to provide amino acid sequences that are directed against (as defined herein) any of IL-17A, IL-17F and/or IL-17A/F including combinations thereof, in particular against any of IL-17A, IL-17F and/or IL-17A/F including combinations thereof from a warm-blooded animal, more in particular against any of IL-17A, IL-17F and/or IL-17A/F including combinations thereof from a mammal, and especially against any of human IL-17A, IL-17F and/or IL-17A/F including combinations thereof; and to provide proteins and polypeptides comprising or essentially consisting of at least one such amino acid sequence.

In particular, it is a specific object of the present invention to provide such amino acid sequences and such proteins and/or polypeptides that are suitable for prophylactic, therapeutic and/or diagnostic use in a warm-blooded animal, and in particular in a mammal, and more in particular in a human being.

More in particular, it is a specific object of the present invention to provide such amino acid sequences and such proteins and/or polypeptides that can be used for the prevention, treatment, alleviation and/or diagnosis of one or more diseases, disorders or conditions associated with any of IL-17A, IL-17F and/or IL-17A/F including combinations thereof and/or mediated by any of IL-17A, IL-17F and/or IL-17A/F including combinations thereof (such as the diseases, disorders and conditions mentioned herein) in a warm-blooded animal, in particular in a mammal, and more in particular in a human being.

It is also a specific object of the invention to provide such amino acid sequences and such proteins and/or polypeptides that can be used in the preparation of pharmaceutical or veterinary compositions for the prevention and/or treatment of one or more diseases, disorders or conditions associated with and/or mediated by any of IL-17A, IL-17F and/or IL-17A/F including combinations thereof (such as the diseases, disorders and conditions mentioned herein) in a warm-blooded animal, in particular in a mammal, and more in particular in a human being.

In the invention, generally, these objects are achieved by the use of the amino acid sequences, proteins, polypeptides and compositions that are described herein. As mentioned, the amino acid sequences used in the invention are preferably immunoglobulin single variable domains or "ISV's" as described herein, and the proteins and polypeptides used in the invention are preferably proteins and polypeptides that comprise one or more of such immunoglobulin single variable domains.

In general, the invention provides amino acid sequences (and preferably ISV's) that are directed against (as defined herein) and/or can specifically bind (as defined herein) to any of IL-17A, IL-17F and/or IL-17A/F including combinations thereof; as well as compounds and constructs, and in particular proteins and polypeptides, that comprise at least one such amino acid sequence.

More in particular, the invention provides amino acid sequences (and preferably ISV's) that can bind to any of IL-17A, IL-17F and/or IL-17A/F including combinations thereof with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein; as well as compounds and constructs, and in particular proteins and polypeptides, that comprise at least one such amino acid sequence.

In particular, amino acid sequences and polypeptides of the invention are preferably such that they:

bind to any of IL-17A, IL-17F and/or IL-17A/F including combinations thereof with a dissociation constant ($K_D$) of $10^{-5}$ to $10^{-12}$ moles/liter or less, such as $10^{-5}$ to $10^{-15}$ moles/liter and preferably $10^{-7}$ to $10^{-12}$ moles/liter or less such as $10^{-7}$ to $10^{-15}$ moles/liter and more preferably $10^{-8}$ to $10^{-12}$ moles/liter or $10^{-8}$ to $10^{-15}$ moles/liter (i.e. with an association constant ($K_A$) of $10^5$ to $10^{12}$ liter/moles or more such as $10^5$ to $10^{15}$ liter/moles, and preferably $10^7$ to $10^{12}$ liter/moles or more such as $10^7$ to $10^{15}$ liter/ and more preferably $10^8$ to $10^{12}$ liter/moles or $10^8$ to $10^{15}$ liter/moles);

and/or such that they:

bind to any of IL-17A, IL-17F and/or IL-17A/F including combinations thereof with a $k_{on}$-rate of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$;

and/or such that they:

bind to any of IL-17A, IL-17F and/or IL-17A/F including combinations thereof with a $k_{off}$ rate between 1 $s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Preferably, a monovalent amino acid sequence of the invention (or a polypeptide that contains only one amino acid sequence of the invention) is preferably such that it will bind to any of IL-17A, IL-17F and/or IL-17A/F including combinations thereof with an affinity less than 500 nM, preferably less than 200 nM, more preferably less than 10 or 1 nM, such as less than 500 pM.

Some preferred IC50 values for binding of the amino acid sequences or polypeptides of the invention to any of IL-17A, IL-17F and/or IL-17A/F including combinations thereof will become clear from the further description and examples herein.

It is noted that as used herein 'can specifically bind to' and 'specifically binds to' are used synonymously and refer to the ability to specifically bind to the respectively indicated entity.

For binding to any of IL-17A, IL-17F and/or IL-17A/F including combinations thereof, an amino acid sequence of the invention will usually contain within its amino acid sequence one or more amino acid residues or one or more stretches of amino acid residues (i.e. with each "stretch" comprising two or amino acid residues that are adjacent to each other or in close proximity to each other, i.e. in the primary or tertiary structure of the amino acid sequence) via which the amino acid sequence of the invention can bind to any of IL-17A, IL-17F and/or IL-17A/F including combinations thereof, which amino acid residues or stretches of amino acid residues thus form the "site" for binding to any of IL-17A, IL-17F and/or IL-17A/F including combinations thereof (also referred to herein as the "antigen binding site").

The amino acid sequences provided by the invention are preferably in essentially isolated form (as defined herein), or form part of a protein or polypeptide of the invention (as defined herein), which may comprise or essentially consist of one or more amino acid sequences of the invention and which may optionally further comprise one or more further amino acid sequences (all optionally linked via one or more suitable linkers). For example, and without limitation, the one or more amino acid sequences of the invention may be used as a binding unit in such a protein or polypeptide, which may optionally contain one or more further amino acid sequences that can serve as a binding unit (i.e. against one or more other targets than any of IL-17A, IL-17F and/or IL-17A/F including combinations thereof), so as to provide a monovalent, multivalent or multispecific polypeptide of the invention, respectively, all as described herein. Such a protein or polypeptide may also be in essentially isolated form (as defined herein).

The amino acid sequences and polypeptides of the invention as such preferably essentially consist of a single amino acid chain that is not linked via disulphide bridges to any other amino acid sequence or chain (but that may or may not contain one or more intramolecular disulphide bridges. For example, it is known that Nanobodies—as described herein—may sometimes contain a disulphide bridge between CDR3 and CDR1 or FR2). However, it should be noted that one or more amino acid sequences of the invention may be linked to each other and/or to other amino acid sequences (e.g. via disulphide bridges) to provide peptide constructs that may also be useful in the invention (for example Fab' fragments, $F(ab')_2$ fragments, ScFv constructs, "diabodies" and other multispecific constructs. Reference is for example made to the review by Holliger and Hudson, Nat. Biotechnol. 2005 September; 23(9):1126-36).

Generally, when an amino acid sequence of the invention (or a compound, construct or polypeptide comprising the same) is intended for administration to a subject (for example for therapeutic and/or diagnostic purposes as described herein), it is preferably either an amino acid sequence that does not occur naturally in said subject; or, when it does occur naturally in said subject, in essentially isolated form (as defined herein).

It will also be clear to the skilled person that for pharmaceutical use, the amino acid sequences of the invention (as well as compounds, constructs and polypeptides comprising the same) are preferably directed against human any of IL-17A, IL-17F and/or IL-17A/F including combinations thereof; whereas for veterinary purposes, the amino acid sequences and polypeptides of the invention are preferably directed against any of IL-17A, IL-17F and/or IL-17A/F including combinations thereof from the species to be treated, or are at least cross-reactive with any of IL-17A, IL-17F and/or IL-17A/F including combinations thereof from the species to be treated.

Furthermore, an amino acid sequence of the invention may optionally, and in addition to the at least one binding site for binding against any of IL-17A, IL-17F and/or IL-17A/F including combinations thereof, contain one or more further binding sites for binding against other antigens, proteins or targets.

In the present description and claims, the following terms are defined as follows:

A) 04G01-like sequences: a "04G01-like sequence", "04G01-like ISV" or "04G01-like building block" is defined as an ISV (as described herein) that comprises:
   a) a CDR1 which comprises or essentially consists of either (i) the amino acid sequence IHVMG or (ii) an amino acid sequence that has only 3, 2 or 1 amino acid difference(s) (as defined herein) with the amino acid sequence IHVMG; and/or
   b) a CDR2 which comprises or essentially consists of either (i) the amino acid sequence LIFSGGSADYADSVKG or (ii) an amino acid sequence that has at least 80%, such as at least 85%, for example at least 90% or more than 95% sequence identity with the amino acid sequence LIFSGGSADYADSVKG; or (iii) an amino acid sequence that has only 7, 6, 5, 4, 3, 2 or 1 amino acid difference(s) (as defined herein) with the amino acid sequence LIFSGGSADYADSVKG; and/or
   c) a CDR3 which comprises or essentially consists of either (i) the amino acid sequence EIGYYSGGTYYSSEAH or (ii) an amino acid sequence that has at least 80%, such as at least 85%, for example at least 90% or more than 95% sequence identity with the amino acid sequence EIGYYSGGTYYSSEAH; or (iii) an amino acid sequence that has only 7, 6, 5, 4, 3, 2 or 1 amino acid difference(s) (as defined herein) with the amino acid sequence EIGYYSGGTYYSSEAH;

in which the framework sequences present in such an ISV are as further described herein, and in which CDR1, CDR2 and CDR3 are preferably such that the 04G01-like ISV has a blocking activity, which can be determined by any suitable assay known to the person skilled in the art, such as, for instance, by means of Alphascreen assays (e.g. such as described herein) or by cell based assays (e.g. such as described herein). Preferably, the blocking activity is determined by a HT-1080 cell based assay, for instance, such as described in Example 9. Preferably, the 04G01-like ISV has a blocking activity of 0.3 μg/ml IL-17A-induced IL-6 production in human fibrosarcoma HT-1080 cells with an IC50 of less than 150 nM, more preferably, less than 100 nM, 50 nM or even less, such as less than 20 nM or 15 nM, 10 nM, 9 nM, 8 nM, 7 nM or 6 nM or even more preferably of less than 5 nM and/or the 04G01-like ISV has a blocking activity of 1.5 μg/ml IL-17A/F-induced IL-6 production in human fibrosarcoma HT-1080 cells with an IC50 of less than 250 nM, more preferably, less than 200 nM, 150 nM or even less, such as less than 100 nM or 80 nM, 75 nM, 70 nM, 60 nM, 50 nM, or 40 nM or even more preferably of less than 35 nM.

Preferably, in such a 04G01-like sequence, CDR1 and CDR2 are as defined under a) and b), respectively; or CDR1 and CDR3 are as defined under a) and c), respectively; or CDR2 and CDR3 are as defined under b) and c), respectively. More preferably, in such a 04G01-like sequence, CDR1, CDR2 and CDR3 are all as defined under a), b) and c), respectively. Again, in such an 04G01-like sequence, CDR1, CDR2 and CDR3 are preferably such that the 04G01-like ISV has a blocking activity, which can be determined by any suitable assay known to the person skilled in the art, such as, for instance, by means of Alphascreen assays (e.g. such as described herein) or by cell based assays (e.g. such as described herein). Preferably, the blocking activity is determined by a HT-1080 cell based assay, for instance, such as described in Example 9. Preferably, the 04G01-like ISV has a blocking activity of 0.3 μg/ml IL-17A-induced IL-6 production in human fibrosarcoma HT-1080 cells with an IC50 of less than 150 nM, more preferably, less than 100 nM, 50 nM or even less, such as less than 20 nM or 15 nM, 10 nM, 9 nM, 8 nM, 7 nM or 6 nM or even more preferably of less than 5 nM and/or the 04G01-like ISV has a blocking activity of 1.5 μg/ml IL-17A/F-induced IL-6 production in human fibrosarcoma HT-1080 cells with an IC50 of less than 250 nM, more preferably, less than 200 nM, 150 nM or even less, such as less than 100 nM or 80 nM, 75 nM, 70 nM, 60 nM, 50 nM, or 40 nM or even more preferably of less than 35 nM.

For example, in such an 04G01-like sequence: CDR1 may comprise or essentially consist of the amino acid sequence IHVMG (with CDR2 and CDR3 being as defined under b) and c), respectively); and/or CDR2 may comprise or essentially consist of the amino acid sequence LIFSGGSADYADSVKG (with CDR1 and CDR3 being as defined under a) and c), respectively); and/or CDR3 may comprise or essentially consist of the amino acid sequence EIGYYSGGTYYSSEAH (with CDR1 and CDR2 being as defined under a) and b), respectively). Particularly, when an 04G01-like sequence is according to this aspect: CDR1 may comprise or essentially consist of the amino acid sequence IHVMG and CDR2 may comprise or essentially consist of the amino acid sequence LIFSGGSADYADSVKG (with CDR3 being as defined under c) above); and/or CDR1 may comprise or essentially consist of the amino acid sequence IHVMG and CDR3 may comprise or essentially consist of the amino acid sequence EIGYYSGGTYYSSEAH (with CDR2 being as defined under b) above); and/or CDR2 may comprise or essentially consist of the amino acid sequence LIFSGGSADYADSVKG and CDR3 may comprise or essentially consist of the amino acid sequence EIGYYSGGTYYSSEAH (with CDR1 being as defined under a) above). Again, in such 04G01-like sequences, CDR1, CDR2 and CDR3 are preferably such that the 04G01-like ISV has a blocking activity, which can be determined by any suitable assay known to the person skilled in the art, such as, for instance, by means of Alphascreen assays (e.g. such as described herein) or by cell based assays (e.g. such as described herein). Preferably, the blocking activity is determined by a HT-1080 cell based assay, for instance, such as described in Example 9. Preferably, the 04G01-like ISV has a blocking activity of 0.3 μg/ml IL-17A-induced IL-6 production in human fibrosarcoma HT-1080 cells with an IC50 of less than 150 nM, more preferably, less than 100 nM, 50 nM or even less, such as less than 20 nM or 15 nM, 10 nM, 9 nM, 8 nM, 7 nM or 6 nM or even more preferably of less than 5 nM and/or the 04G01-like ISV has a blocking activity of 1.5 μg/ml IL-17A/F-induced IL-6 production in human fibrosarcoma HT-1080 cells with an IC50 of less than 250 nM, more preferably, less than 200 nM, 150 nM or even less, such as less than 100 nM or 80 nM, 75 nM, 70 nM, 60 nM, 50 nM, or 40 nM or even more preferably of less than 35 nM.

In a specifically preferred aspect, a "04G01-like sequence", "04G01-like ISV" or "04G01-like building block" is an ISV that comprises:

d) a CDR1 which is either (i) the amino acid sequence IHVMG or (ii) an amino acid sequence that has only 3, 2 or 1 amino acid difference(s) (as defined herein) with the amino acid sequence IHVMG; and/or e) a CDR2 which is either (i) the amino acid sequence LIFSGGSADYADSVKG or (ii) an amino acid sequence that has at least 80%, such as at least 85%, for example at least 90% or more than 95% sequence identity with the amino acid sequence LIFSGGSADYADSVKG; or (iii) an amino acid sequence that has only 7, 6, 5, 4, 3, 2 or 1 amino acid difference(s) (as defined herein) with the amino acid sequence LIFSGGSADYADSVKG; and/or f) a CDR3 which is either (i) the amino acid sequence EIGYYSGGTYYSSEAH or (ii) an amino acid sequence that has at least 80%, such as at least 85%, for example at least 90% or more than 95% sequence identity with the amino acid sequence EIGYYSGGTYYSSEAH; or (iii) an amino acid sequence that has only 7, 6, 5, 4, 3, 2 or 1 amino acid difference(s) (as defined herein) with the amino acid sequence EIGYYSGGTYYSSEAH;

in which the framework sequences present in such an ISV are as further described herein, and in which CDR1, CDR2 and CDR3 are preferably such that the 04G01-like ISV has a blocking activity, which can be determined by any suitable assay known to the person skilled in the art, such as, for instance, by means of Alphascreen assays (e.g. such as described herein) or by cell based assays (e.g. such as described herein). Preferably, the blocking activity is determined by a HT-1080 cell based assay, for instance, such as described in Example 9. Preferably, the 04G01-like ISV has a blocking activity of 0.3 μg/ml IL-17A-induced IL-6 production in human fibrosarcoma HT-1080 cells with an IC50 of less than 150 nM, more preferably, less than 100 nM, 50 nM or even less, such as less than 20 nM or 15 nM, 10 nM, 9 nM, 8 nM, 7 nM or 6 nM or even more preferably of less than 5 nM and/or the 04G01-like ISV has a blocking activity of 1.5 μg/ml IL-17A/F-induced IL-6 production in human fibrosarcoma HT-1080 cells with an IC50 of less than 250 nM, more preferably, less than 200 nM, 150 nM or even less, such as less than 100 nM or 80 nM, 75 nM, 70 nM, 60 nM, 50 nM, or 40 nM or even more preferably of less than 35 nM.

Preferably, in a 04G01-like sequence according to this specifically preferred aspect, CDR1 and CDR2 are as defined under d) and e), respectively; or CDR1 and CDR3 are as defined under d) and f), respectively; or CDR2 and CDR3 are as defined under e) and f), respectively. More preferably, in such a 04G01-like sequence, CDR1, CDR2 and CDR3 are all as defined under d), e) and f), respectively. Again, in such an 04G01-like sequence, CDR1, CDR2 and CDR3 are preferably such that the 04G01-like ISV has a blocking activity, which can be determined by any suitable assay known to the person skilled in the art, such as, for instance, by means of Alphascreen assays (e.g. such as described herein) or by cell based assays (e.g. such as described herein). Preferably, the blocking activity is determined by a HT-1080 cell based assay, for instance, such as described in Example 9. Preferably, the 04G01-like ISV has a blocking activity of 0.3 μg/ml IL-17A-induced IL-6 production in human fibrosarcoma HT-1080 cells with an IC50 of less than 150 nM, more preferably, less than 100 nM, 50 nM or even less, such as less than 20 nM or 15 nM, 10 nM, 9 nM, 8 nM, 7 nM or 6 nM or even more preferably of less than 5 nM and/or the 04G01-like ISV has a blocking activity of 1.5 μg/ml IL-17A/F-induced IL-6 production in human fibrosarcoma HT-1080 cells with an IC50 of less than 250 nM, more preferably, less than 200 nM, 150 nM or even less, such as less than 100 nM or 80 nM, 75 nM, 70 nM, 60 nM, 50 nM, or 40 nM or even more preferably of less than 35 nM. For example, in a 04G01-like sequence according to this specifically preferred aspect: CDR1 is the amino acid sequence IHVMG (with CDR2 and CDR3 being as defined under e) and f), respectively); and/or CDR2 is the amino acid sequence LIFSGGSADYADSVKG (with CDR1 and CDR3 being as defined under d) and f), respectively); and/or CDR3 is the amino acid sequence EIGYYSGGTYYSSEAH (with CDR1 and CDR2 being as defined under d) and e), respectively). Particularly, when an 04G01-like sequence is according to this aspect: CDR1 is the amino acid sequence IHVMG and CDR2 is the amino acid sequence LIFSGGSADYADSVKG (with CDR3 being as defined under 0 above); and/or CDR1 is the amino acid sequence IHVMG and CDR3 is the amino acid sequence EIGYYSGGTYYSSEAH (with CDR2 being as defined under e) above); and/or CDR2 is the amino acid sequence LIFSGGSADYADSVKG and CDR3 is EIGYYSGGTYYSSEAH (with CDR1 being as defined under d) above). Again, in such 04G01-like sequences, CDR1, CDR2 and CDR3 are preferably such that the 04G01-like ISV has a blocking activity, which can be determined by any suitable assay known to the person skilled in the art, such as, for instance, by means of Alphascreen assays (e.g. such as described herein) or by cell based assays (e.g. such as described herein). Preferably, the blocking activity is determined by a HT-1080 cell based assay, for instance, such as described in Example 9. Preferably, the 04G01-like ISV has a blocking activity of 0.3 μg/ml IL-17A-induced IL-6 production in human fibrosarcoma HT-1080 cells with an IC50 of less than 150 nM, more preferably, less than 100 nM, 50 nM or even less, such as less than 20 nM or 15 nM, 10 nM, 9 nM, 8 nM, 7 nM or 6 nM or even more preferably of less than 5 nM and/or the 04G01-like ISV has a blocking activity of 1.5 μg/ml IL-17A/F-induced IL-6 production in human fibrosarcoma HT-1080 cells with an IC50 of less than 250 nM, more preferably, less than 200 nM, 150 nM or even less, such as less than 100 nM or 80 nM, 75 nM, 70 nM, 60 nM, 50 nM, or 40 nM or even more preferably of less than 35 nM.

In a particularly preferred 04G01-like sequence: CDR1 is the amino acid sequence IHVMG, CDR2 is the amino acid sequence LIFSGGSADYADSVKG; and CDR3 is the amino acid sequence EIGYYSGGTYYSSEAH.

In all the 04G01-like sequence described in this paragraph A), the framework sequences may be as further described herein. Preferably, the framework sequences are such that the framework sequences have at least 80%, such as at least 85%, for example at least 90%, such as at least 95% sequence identity with the framework sequences of 04G01 (which, for example, can be determined by determining the overall degree of sequence identity of a given sequence with the sequence of 04G01 while disregarding the CDR's in the calculation). Again, the combination of CDR's and frameworks present in a given sequence are preferably such that the resulting 04G01-like ISV has a blocking activity, which can be determined by any suitable assay known to the person skilled in the art, such as, for instance, by means of Alphascreen assays (e.g. such as described herein) or by cell based assays (e.g. such as described herein). Preferably, the blocking activity is determined by a HT-1080 cell based assay, for instance, such as described in Example 9. Preferably, the 04G01-like ISV has a blocking activity of 0.3 μg/ml IL-17A-induced IL-6 production in human fibrosarcoma HT-1080 cells with an IC50 of less than 150 nM, more preferably, less than 100 nM, 50 nM or even less, such as less than 20 nM or 15 nM, 10 nM, 9 nM, 8 nM, 7 nM or 6 nM or even more preferably of less than 5 nM and/or the 04G01-like ISV has a blocking activity of 1.5 μg/ml IL-17A/F-induced IL-6 production in human fibrosarcoma HT-1080 cells with an IC50 of less than 250 nM, more preferably, less than 200 nM, 150 nM or even less, such as less than 100 nM or 80 nM, 75 nM, 70 nM, 60 nM, 50 nM, or 40 nM or even more preferably of less than 35 nM. In one specific aspect, a 04G01-like sequence is an ISV that has at least 70%, such at least 80%, for example at least 85%, such as at least 90% or more than 95% sequence identity with SEQ ID NO: 635. For example, in an 04G01-like sequence according to this aspect, the CDR's may be according to the specifically preferred aspect described above, and may in particularly (but without limitation) be IHVMG (CDR1); LIFSGGSADYADSVKG (CDR2); and EIGYYSGGTYYSSEAH (CDR3). Again, preferably, the combination of CDR's and frameworks present in such a 04G01-like ISV are preferably such that the resulting 04G01-like ISV has a blocking activity, which can be determined by any suitable assay known to the person skilled in the art, such as, for instance, by means of Alphascreen assays (e.g. such as described herein) or by cell based assays (e.g. such as described herein). Preferably, the blocking activity is determined by a HT-1080 cell based assay, for instance, such as described in Example 9. Preferably, the 04G01-like ISV has a blocking activity of 0.3

μg/ml IL-17A-induced IL-6 production in human fibrosarcoma HT-1080 cells with an IC50 of less than 150 nM, more preferably, less than 100 nM, 50 nM or even less, such as less than 20 nM or 15 nM, 10 nM, 9 nM, 8 nM, 7 nM or 6 nM or even more preferably of less than 5 nM and/or the 04G01-like ISV has a blocking activity of 1.5 μg/ml IL-17A/F-induced IL-6 production in human fibrosarcoma HT-1080 cells with an IC50 of less than 250 nM, more preferably, less than 200 nM, 150 nM or even less, such as less than 100 nM or 80 nM, 75 nM, 70 nM, 60 nM, 50 nM, or 40 nM or even more preferably of less than 35 nM.

In one particular aspect, any 04G01-like sequence may be a humanized and/or sequence optimized sequence, as further described herein.

B) 16A04-like sequences: a "16A04-like sequence", "16A04-like ISV" or "16A04-like building block" is defined as an ISV (as described herein) that comprises:

a) a CDR1 which comprises or essentially consists of either (i) the amino acid sequence SYVVG or (ii) an amino acid sequence that has only 2 or (preferably) 1 amino acid difference(s) (as defined herein) with the amino acid sequence SYVVG; and/or b) a CDR2 which comprises or essentially consists of either (i) the amino acid sequence AISGSGDSIYYAVSEKD or (ii) an amino acid sequence that has at least 80%, such as at least 85%, for example at least 90% or more than 95% sequence identity with the amino acid sequence AISGSGDSIYYAVSEKD; or (iii) an amino acid sequence that has only 7, 6, 5, 4, 3, 2 or 1 amino acid difference(s) (as defined herein) with the amino acid sequence AISGSGDSIYYAVSEKD; and/or c) a CDR3 which comprises or essentially consists of either (i) the amino acid sequence DQEFGYLRFGRSEY or (ii) an amino acid sequence that has at least 80%, such as at least 85%, for example at least 90% or more than 95% sequence identity with the amino acid sequence DQEFGYLRFGRSEY; or (iii) an amino acid sequence that has only 7, 6, 5, 4, 3, 2 or 1 amino acid difference(s) (as defined herein) with the amino acid sequence DQEFGYLRFGRSEY;

in which the framework sequences present in such an ISV are as further described herein, and in which CDR1, CDR2 and CDR3 are preferably such that the 16A04-like ISV has a blocking activity, which can be determined by any suitable assay known to the person skilled in the art, such as, for instance, by means of Alphascreen assays (e.g. such as described herein) or by cell based assays (e.g. such as described herein). Preferably, the blocking activity is determined by a HT-1080 cell based assay, such as, for instance, described in Example 9. Preferably, the 16A04-like ISV has a blocking activity of 4.5 μg/ml IL-17F-induced IL-6 production in human fibrosarcoma HT-1080 cells with an IC50 of less than 300 nM, more preferably, less than 250 nM or even less, such as less than 200 nM or 180 nM, 175 nM, 160 nM or even more preferably of less than 150 nM and/or the 16A04-like ISV has a blocking activity of 1.5 μg/ml IL-17A/F-induced IL-6 production in human fibrosarcoma HT-1080 cells with an IC50 of less than 250 nM, more preferably, less than 200 nM, 150 nM or even less, such as less than 100 nM or 80 nM, 75 nM, 70 nM, 65 nM, 60 nM, or 55 nM or even more preferably of less than 50 nM. Preferably, in such a 16A04-like sequence, CDR1 and CDR2 are as defined under a) and b), respectively; or CDR1 and CDR3 are as defined under a) and c), respectively; or CDR2 and CDR3 are as defined under b) and c), respectively. More preferably, in such a 16A04-like sequence, CDR1, CDR2 and CDR3 are all as defined under a), b) and c), respectively. Again, in such an 16A04-like sequence, CDR1, CDR2 and CDR3 are preferably such that the 16A04-like ISV has a blocking activity, which can be determined by any suitable assay known to the person skilled in the art, such as, for instance, by means of Alphascreen assays (e.g. such as described herein) or by cell based assays (e.g. such as described herein). Preferably, the blocking activity is determined by a HT-1080 cell based assay, such as, for instance, described in Example 9. Preferably, the 16A04-like ISV has a blocking activity of 4.5 μg/ml IL-17F-induced IL-6 production in human fibrosarcoma HT-1080 cells with an IC50 of less than 300 nM, more preferably, less than 250 nM or even less, such as less than 200 nM or 180 nM, 175 nM, 160 nM or even more preferably of less than 150 nM and/or the 16A04-like ISV has a blocking activity of 1.5 μg/ml IL-17A/F-induced IL-6 production in human fibrosarcoma HT-1080 cells with an IC50 of less than 250 nM, more preferably, less than 200 nM, 150 nM or even less, such as less than 100 nM or 80 nM, 75 nM, 70 nM, 65 nM, 60 nM, or 55 nM or even more preferably of less than 50 nM.

For example, in such an 16A04-like sequence: CDR1 may comprise or essentially consist of the amino acid sequence SYVVG (with CDR2 and CDR3 being as defined under b) and c), respectively); and/or CDR2 may comprise or essentially consist of the amino acid sequence AISGSGDSIYYAVSEKD (with CDR1 and CDR3 being as defined under a) and c), respectively); and/or CDR3 may comprise or essentially consist of the amino acid sequence DQEFGYLRFGRSEY (with CDR1 and CDR2 being as defined under a) and b), respectively). Particularly, when an 16A04-like sequence is according to this aspect: CDR1 may comprise or essentially consist of the amino acid sequence SYVVG and CDR2 may comprise or essentially consist of the amino acid sequence AISGSGDSIYYAVSEKD (with CDR3 being as defined under c) above); and/or CDR1 may comprise or essentially consist of the amino acid sequence SYVVG and CDR3 may comprise or essentially consist of the amino acid sequence DQEFGYLRFGRSEY (with CDR2 being as defined under b) above); and/or CDR2 may comprise or essentially consist of the amino acid sequence AISGSGDSIYYAVSEKD and CDR3 may comprise or essentially consist of the amino acid sequence DQEFGYLRFGRSEY (with CDR1 being as defined under a) above). Again, in such 16A04-like sequences, CDR1, CDR2 and CDR3 are preferably such that the 16A04-like ISV has a blocking activity, which can be determined by any suitable assay known to the person skilled in the art, such as, for instance, by means of Alphascreen assays (e.g. such as described herein) or by cell based assays (e.g. such as described herein). Preferably, the blocking activity is determined by a HT-1080 cell based assay, such as, for instance, described in Example 9. Preferably, the 16A04-like ISV has a blocking activity of 4.5 μg/ml IL-17F-induced IL-6 production in human fibrosarcoma HT-1080 cells with an IC50 of less than 300 nM, more preferably, less than 250 nM or even less, such as less than 200 nM or 180 nM, 175 nM, 160 nM or even more preferably of less than 150 nM and/or the 16A04-like ISV has a blocking activity of 1.5 μg/ml IL-17A/F-induced IL-6 production in human fibrosarcoma HT-1080 cells with an IC50 of less than 250 nM, more preferably, less than 200 nM, 150 nM or even less, such as less than 100 nM or 80 nM, 75 nM, 70 nM, 65 nM, 60 nM, or 55 nM or even more preferably of less than 50 nM.

In a specifically preferred aspect, a "16A04-like sequence", "16A04-like ISV" or "16A04-like building block" is an ISV that comprises:

d) a CDR1 which is either (i) the amino acid sequence SYVVG or (ii) an amino acid sequence that has only 2 or (preferably) 1 amino acid difference(s) (as defined herein) with the amino acid sequence SYVVG; and/or e) a CDR2 which is either (i) the amino acid sequence AISGSGDSIYYAVSEKD or (ii) an amino acid sequence that has at least 80%, such as at least 85%, for example at least 90% or more than 95% sequence identity with the amino acid sequence AISGSGDSIYYAVSEKD; or (iii) an amino acid sequence that has only 7, 6, 5, 4, 3, 2 or 1 amino acid difference(s) (as defined herein) with the amino acid sequence AISGSGDSIYYAVSEKD; and/or f) a CDR3 which is either (i) the amino acid sequence DQEFGYLRFGRSEY or (ii) an amino acid sequence that has at least 80%, such as at least 85%, for example at least 90% or more than 95% sequence identity with the amino acid sequence DQEFGYLRFGRSEY; or (iii) an amino acid sequence that has only 7, 6, 5, 4, 3, 2 or 1 amino acid difference(s) (as defined herein) with the amino acid sequence DQEFGYLRFGRSEY;

in which the framework sequences present in such an ISV are as further described herein, and in which CDR1, CDR2 and CDR3 are preferably such that the 16A04-like ISV has a blocking activity, which can be determined by any suitable assay known to the person skilled in the art, such as, for instance, by means of Alphascreen assays (e.g. such as described herein) or by cell based assays (e.g. such as described herein). Preferably, the blocking activity is determined by a HT-1080 cell based assay, such as, for instance, described in Example 9. Preferably, the 16A04-like ISV has a blocking activity of 4.5 μg/ml IL-17F-induced IL-6 production in human fibrosarcoma HT-1080 cells with an IC50 of less than 300 nM, more preferably, less than 250 nM or even less, such as less than 200 nM or 180 nM, 175 nM, 160 nM or even more preferably of less than 150 nM and/or the 16A04-like ISV has a blocking activity of 1.5 μg/ml IL-17A/F-induced IL-6 production in human fibrosarcoma HT-1080 cells with an IC50 of less than 250 nM, more preferably, less than 200 nM, 150 nM or even less, such as less than 100 nM or 80 nM, 75 nM, 70 nM, 65 nM, 60 nM, or 55 nM or even more preferably of less than 50 nM. Preferably, in a 16A04-like sequence according to this specifically preferred aspect, CDR1 and CDR2 are as defined under d) and e), respectively; or CDR1 and CDR3 are as defined under d) and f), respectively; or CDR2 and CDR3 are as defined under e) and f), respectively. More preferably, in such a 16A04-like sequence, CDR1, CDR2 and CDR3 are all as defined under d), e) and f), respectively. Again, in such an 16A04-like sequence, CDR1, CDR2 and CDR3 are preferably such that the 16A04-like ISV has a blocking activity, which can be determined by any suitable assay known to the person skilled in the art, such as, for instance, by means of Alphascreen assays (e.g. such as described herein) or by cell based assays (e.g. such as described herein). Preferably, the blocking activity is determined by a HT-1080 cell based assay, such as, for instance, described in Example 9. Preferably, the 16A04-like ISV has a blocking activity of 4.5 μg/ml IL-17F-induced IL-6 production in human fibrosarcoma HT-1080 cells with an IC50 of less than 300 nM, more preferably, less than 250 nM or even less, such as less than 200 nM or 180 nM, 175 nM, 160 nM or even more preferably of less than 150 nM and/or the 16A04-like ISV has a blocking activity of 1.5 μg/ml IL-17A/F-induced IL-6 production in human fibrosarcoma HT-1080 cells with an IC50 of less than 250 nM, more preferably, less than 200 nM, 150 nM or even less, such as less than 100 nM or 80 nM, 75 nM, 70 nM, 65 nM, 60 nM, or 55 nM or even more preferably of less than 50 nM.

For example, in a 16A04-like sequence according to this specifically preferred aspect: CDR1 is the amino acid sequence SYVVG (with CDR2 and CDR3 being as defined under e) and f), respectively); and/or CDR2 is the amino acid sequence AISGSGDSIYYAVSEKD (with CDR1 and CDR3 being as defined under d) and f), respectively); and/or CDR3 is the amino acid sequence DQEFGYLRFGRSEY (with CDR1 and CDR2 being as defined under d) and e), respectively). Particularly, when an 16A04-like sequence is according to this aspect: CDR1 is the amino acid sequence SYVVG and CDR2 is the amino acid sequence AISGSGDSIYYAVSEKD (with CDR3 being as defined under f) above); and/or CDR1 is the amino acid sequence SYVVG and CDR3 is the amino acid sequence DQEFGYLRFGRSEY (with CDR2 being as defined under e) above); and/or CDR2 is the amino acid sequence AISGSGDSIYYAVSEKD and CDR3 is DQEFGYLRFGRSEY (with CDR1 being as defined under d) above). Again, in such 16A04-like sequences, CDR1, CDR2 and CDR3 are preferably such that the 16A04-like ISV has a blocking activity, which can be determined by any suitable assay known to the person skilled in the art, such as, for instance, by means of Alphascreen assays (e.g. such as described herein) or by cell based assays (e.g. such as described herein). Preferably, the blocking activity is determined by a HT-1080 cell based assay, such as, for instance, described in Example 9. Preferably, the 16A04-like ISV has a blocking activity of 4.5 μg/ml IL-17F-induced IL-6 production in human fibrosarcoma HT-1080 cells with an IC50 of less than 300 nM, more preferably, less than 250 nM or even less, such as less than 200 nM or 180 nM, 175 nM, 160 nM or even more preferably of less than 150 nM and/or the 16A04-like ISV has a blocking activity of 1.5 μg/ml IL-17A/F-induced IL-6 production in human fibrosarcoma HT-1080 cells with an IC50 of less than 250 nM, more preferably, less than 200 nM, 150 nM or even less, such as less than 100 nM or 80 nM, 75 nM, 70 nM, 65 nM, 60 nM, or 55 nM or even more preferably of less than 50 nM.

In a particularly preferred 16A04-like sequence: CDR1 is the amino acid sequence SYVVG, CDR2 is the amino acid sequence AISGSGDSIYYAVSEKD; and CDR3 is the amino acid sequence DQEFGYLRFGRSEY.

In all the 16A04-like sequence described in this paragraph B), the framework sequences may be as further described herein. Preferably, the framework sequences are such that the framework sequences have at least 80%, such as at least 85%, for example at least 90%, such as at least 95% sequence identity with the framework sequences of 16A04 (which, for example, can be determined by determining the overall degree of sequence identity of a given sequence with the sequence of 16A04 while disregarding the CDR's in the calculation). Again, the combination of CDR's and frameworks present in a given sequence are preferably such that the resulting 16A04-like ISV has a blocking activity, which can be determined by any suitable assay known to the person skilled in the art, such as, for instance, by means of Alphascreen assays (e.g. such as described herein) or by cell based assays (e.g. such as described herein). Preferably, the blocking activity is determined by a HT-1080 cell based assay, such as, for instance, described in Example 9. Preferably, the 16A04-like ISV has a blocking activity of 4.5 μg/ml IL-17F-induced IL-6 production in human fibrosarcoma HT-1080 cells with an IC50 of less than 300 nM, more preferably, less than 250 nM or even less, such as less than 200 nM or 180 nM, 175 nM, 160 nM or even more preferably of less than 150 nM and/or the 16A04-like ISV has a blocking activity of 1.5 μg/ml IL-17A/F-induced IL-6 production in human fibrosarcoma HT-1080 cells with an IC50 of less than 250 nM, more preferably, less than 200 nM, 150 nM or even less, such as less than 100 nM or 80 nM, 75 nM, 70 nM, 65 nM, 60 nM, or 55 nM or even more preferably of less than 50 nM.

In one specific aspect, a 16A04-like sequence is an ISV that has at least 70%, such at least 80%, for example at least 85%, such as at least 90% or more than 95% sequence identity with SEQ ID NO: 648. For example, in an 16A04-like sequence according to this aspect, the CDR's may be according to the specifically preferred aspect described above, and may in particularly (but without limitation) be SYVVG (CDR1); AISGSGDSIYYAVSEKD (CDR2); and DQEFGYLRFGRSEY (CDR3). Again, preferably, the combination of CDR's and frameworks present in such a 16A04-like ISV are preferably such that the resulting 16A04-like ISV has a blocking activity, which can be determined by any suitable assay known to the person skilled in the art, such as, for instance, by means of Alphascreen assays (e.g. such as described herein) or by cell based assays (e.g. such as described herein). Preferably, the blocking activity is determined by a HT-1080 cell based assay, such as, for instance, described in Example 9. Preferably, the 16A04-like ISV has a blocking activity of 4.5 μg/ml IL-17F-induced IL-6 production in human fibrosarcoma HT-1080 cells with an IC50 of less than 300 nM, more preferably, less than 250 nM or even less, such as less than 200 nM or 180 nM, 175 nM, 160 nM or even more preferably of less than 150 nM and/or the 16A04-like ISV has a blocking activity of 1.5 μg/ml IL-17A/F-induced IL-6 production in human fibrosarcoma HT-1080 cells with an IC50 of less than 250 nM, more preferably, less than 200 nM, 150 nM or even less, such as less than 100 nM or 80 nM, 75 nM, 70 nM, 65 nM, 60 nM, or 55 nM or even more preferably of less than 50 nM.

In one particular aspect, any 16A04-like sequence may be a humanized sequence, as further described herein.

C) 13B03-like sequences: a "13B03-like sequence", "13B03-like ISV" or "13B03-like building block" is defined as an ISV (as described herein) that comprises:

a) a CDR1 which comprises or essentially consists of either (i) the amino acid sequence INWFG or (ii) an amino acid sequence that has only 3, 2 or 1 amino acid difference(s) (as defined herein) with the amino acid sequence INWFG; and/or b) a CDR2 which comprises or essentially consists of either (i) the amino acid sequence GIRWSDAYTEYANSVKG or (ii) an amino acid sequence that has at least 80%, such as at least 85%, for example at least 90% or more than 95% sequence identity with the amino acid sequence GIRWSDAYTEYANSVKG; or (iii) an amino acid sequence that has only 7, 6, 5, 4, 3, 2 or 1 amino acid difference(s) (as defined herein) with the amino acid sequence GIRWSDAYTEYANSVKG; and/or c) a CDR3 which comprises or essentially consists of either (i) the amino acid sequence DLSTVRY or (ii) an amino acid sequence that has at least 80%, such as at least 85%, for example at least 90% or more than 95% sequence identity with the amino acid sequence DLSTVRY; or (iii) an amino acid sequence that has only 4, 3, 2 or 1 amino acid difference(s) (as defined herein) with the amino acid sequence DLSTVRY;

in which the framework sequences present in such an ISV are as further described herein, and in which CDR1, CDR2 and CDR3 are preferably such that the 13B03-like ISV has a blocking activity, which can be determined by any suitable assay known to the person skilled in the art, such as, for instance, by means of Alphascreen assays (e.g. such as described herein) or by cell based assays (e.g. such as described herein). Preferably, the blocking activity is determined by a HT-1080 cell based assay, for instance, such as described in Example 9. Preferably, the 13B03-like ISV has a blocking activity of 0.3 μg/ml IL-17A-induced IL-6 production in human fibrosarcoma HT-1080 cells with an IC50 of less than 150 nM, more preferably, less than 100 nM, 50 nM or even less, such as less than 20 nM or 15 nM, 10 nM, 9 nM, 8 nM, 7 nM or 6 nM or even more preferably of less than 5 nM, and/or the 13B03-like ISV has a blocking activity of 4.5 μg/ml IL-17F-induced IL-6 production in human fibrosarcoma HT-1080 cells with an IC50 of less than 350 nM, more preferably, less than 300 nM, 250 nM or even less, such as less than 200 nM or 175 nM, 160 nM, or 155 nM or even more preferably of less than 150 nM and/or the 13B03-like ISV has a blocking activity of 1.5 μg/ml IL-17A/F-induced IL-6 production in human fibrosarcoma HT-1080 cells with an IC50 of less than 200 nM, more preferably, less than 150 nM, 125 nM or even less, such as less than 100 nM or 80 nM, 75 nM, 70 nM, 60 nM, 50 nM, or 40 nM or even more preferably of less than 30 nM. Preferably, in such a 13B03-like sequence, CDR1 and CDR2 are as defined under a) and b), respectively; or CDR1 and CDR3 are as defined under a) and c), respectively; or CDR2 and CDR3 are as defined under b) and c), respectively. More preferably, in such a 13B03-like sequence, CDR1, CDR2 and CDR3 are all as defined under a), b) and c), respectively. Again, in such an 13B03-like sequence, CDR1, CDR2 and CDR3 are preferably such that the 13B03-like ISV has a blocking activity, which can be determined by any suitable assay known to the person skilled in the art, such as, for instance, by means of Alphascreen assays (e.g. such as described herein) or by cell based assays (e.g. such as described herein). Preferably, the blocking activity is determined by a HT-1080 cell based assay, for instance, such as described in Example 9. Preferably, the 13B03-like ISV has a blocking activity of 0.3 μg/ml IL-17A-induced IL-6 production in human fibrosarcoma HT-1080 cells with an IC50 of less than 150 nM, more preferably, less than 100 nM, 50 nM or even less, such as less than 20 nM or 15 nM, 10 nM, 9 nM, 8 nM, 7 nM or 6 nM or even more preferably of less than 5 nM, and/or the 13B03-like ISV has a blocking activity of 4.5 μg/ml IL-17F-induced IL-6 production in human fibrosarcoma HT-1080 cells with an IC50 of less than 350 nM, more preferably, less than 300 nM, 250 nM or even less, such as less than 200 nM or 175 nM, 160 nM, or 155 nM or even more preferably of less than 150 nM and/or the 13B03-like ISV has a blocking activity of 1.5 μg/ml IL-17A/F-induced IL-6 production in human fibrosarcoma HT-1080 cells with an IC50 of less than 200 nM, more preferably, less than 150 nM, 125 nM or even less, such as less than 100 nM or 80 nM, 75 nM, 70 nM, 60 nM, 50 nM, or 40 nM or even more preferably of less than 30 nM.

For example, in such an 13B03-like sequence: CDR1 may comprise or essentially consist of the amino acid sequence INWFG (with CDR2 and CDR3 being as defined under b) and c), respectively); and/or CDR2 may comprise or essentially consist of the amino acid sequence GIRWSDAYTEYANSVKG (with CDR1 and CDR3 being as defined under a) and c), respectively); and/or CDR3 may comprise or essentially consist of the amino acid sequence DLSTVRY (with CDR1 and CDR2 being as defined under a) and b), respectively). Particularly, when an 13B03-like sequence is according to this aspect: CDR1 may comprise or essentially consist of the amino acid sequence INWFG and CDR2 may comprise or essentially consist of the amino acid sequence GIRWSDAYTEYANSVKG (with CDR3 being as defined under c) above); and/or CDR1 may comprise or essentially consist of the amino acid sequence INWFG and CDR3 may comprise or essentially consist of the amino acid sequence DLSTVRY (with CDR2 being as defined under b) above); and/or CDR2 may comprise or essentially consist of the amino acid sequence GIRWSDAYTEYANSVKG and CDR3 may comprise or essentially consist of the amino acid sequence DLSTVRY (with CDR1 being as defined under a) above). Again, in such 13B03-like sequences, CDR1, CDR2 and CDR3 are preferably such that the 13B03-like ISV has a blocking activity, which can be determined by any suitable assay known to the person skilled in the art, such as, for instance, by means of Alphascreen assays (e.g. such as described herein) or by cell based assays (e.g. such as described herein). Preferably, the blocking activity is determined by a HT-1080 cell based assay, for instance, such as described in Example 9. Preferably, the 13B03-like ISV has a blocking activity of 0.3 μg/ml IL-17A-induced IL-6 production in human fibrosarcoma HT-1080 cells with an IC50 of less than 150 nM, more preferably, less than 100 nM, 50 nM or even less, such as less than 20 nM or 15 nM, 10 nM, 9 nM, 8 nM, 7 nM or 6 nM or even more preferably of less than 5 nM, and/or the 13B03-like ISV has a blocking activity of 4.5 μg/ml IL-17F-induced IL-6 production in human fibrosarcoma HT-1080 cells with an IC50 of less than 350 nM, more preferably, less than 300 nM, 250 nM or even less, such as less than 200 nM or 175 nM, 160 nM, or 155 nM or even more preferably of less than 150 nM and/or the 13B03-like ISV has a blocking activity of 1.5 μg/ml IL-17A/F-induced IL-6 production in human fibrosarcoma HT-1080 cells with an IC50 of less than 200 nM, more preferably, less than 150 nM, 125 nM or even less, such as less than 100 nM or 80 nM, 75 nM, 70 nM, 60 nM, 50 nM, or 40 nM or even more preferably of less than 30 nM.

In a specifically preferred aspect, a "13B03-like sequence", "13B03-like ISV" or "13B03-like building block" is an ISV that comprises:

d) a CDR1 which is either (i) the amino acid sequence INWFG or (ii) an amino acid sequence that has only 3, 2 or 1 amino acid difference(s) (as defined herein) with the amino acid sequence INWFG; and/or e) a CDR2 which is either (i) the amino acid sequence GIRWSDAYTEYANSVKG or (ii) an amino acid sequence that has at least 80%, such as at least 85%, for example at least 90% or more than 95% sequence identity with the amino acid sequence GIRWSDAYTEYANSVKG; or (iii) an amino acid sequence that has only 7, 6, 5, 4, 3, 2 or 1 amino acid difference(s) (as defined herein) with the amino acid sequence GIRWSDAYTEYANSVKG; and/or f) a CDR3 which is either (i) the amino acid sequence DLSTVRY or (ii) an amino acid sequence that has at least 80%, such as at least 85%, for example at least 90% or more than 95% sequence identity with the amino acid sequence DLSTVRY; or (iii) an amino acid sequence that has only 4, 3, 2 or 1 amino acid difference(s) (as defined herein) with the amino acid sequence DLSTVRY;

in which the framework sequences present in such an ISV are as further described herein, and in which CDR1, CDR2 and CDR3 are preferably such that the 13B03-like ISV has a blocking activity, which can be determined by any suitable assay known to the person skilled in the art, such as, for instance, by means of Alphascreen assays (e.g. such as described herein) or by cell based assays (e.g. such as described herein). Preferably, the blocking activity is determined by a HT-1080 cell based assay, for instance, such as described in Example 9. Preferably, the 13B03-like ISV has a blocking activity of 0.3 μg/ml IL-17A-induced IL-6 production in human fibrosarcoma HT-1080 cells with an IC50 of less than 150 nM, more preferably, less than 100 nM, 50 nM or even less, such as less than 20 nM or 15 nM, 10 nM, 9 nM, 8 nM, 7 nM or 6 nM or even more preferably of less than 5 nM, and/or the 13B03-like ISV has a blocking activity of 4.5 μg/ml IL-17F-induced IL-6 production in human fibrosarcoma HT-1080 cells with an IC50 of less than 350 nM, more preferably, less than 300 nM, 250 nM or even less, such as less than 200 nM or 175 nM, 160 nM, or 155 nM or even more preferably of less than 150 nM and/or the 13B03-like ISV has a blocking activity of 1.5 μg/ml IL-17A/F-induced IL-6 production in human fibrosarcoma HT-1080 cells with an IC50 of less than 200 nM, more preferably, less than 150 nM, 125 nM or even less, such as less than 100 nM or 80 nM, 75 nM, 70 nM, 60 nM, 50 nM, or 40 nM or even more preferably of less than 30 nM. Preferably, in a 13B03-like sequence according to this specifically preferred aspect, CDR1 and CDR2 are as defined under d) and e), respectively; or CDR1 and CDR3 are as defined under d) and f), respectively; or CDR2 and CDR3 are as defined under e) and f), respectively. More preferably, in such a 13B03-like sequence, CDR1, CDR2 and CDR3 are all as defined under d), e) and f), respectively. Again, in such an 13B03-like sequence, CDR1, CDR2 and CDR3 are preferably such that the 13B03-like ISV has a blocking activity, which can be determined by any suitable assay known to the person skilled in the art, such as, for instance, by means of Alphascreen assays (e.g. such as described herein) or by cell based assays (e.g. such as described herein). Preferably, the blocking activity is determined by a HT-1080 cell based assay, for instance, such as described in Example 9. Preferably, the 13B03-like ISV has a blocking activity of 0.3 μg/ml IL-17A-induced IL-6 production in human fibrosarcoma HT-1080 cells with an IC50 of less than 150 nM, more preferably, less than 100 nM, 50 nM or even less, such as less than 20 nM or 15 nM, 10 nM, 9 nM, 8 nM, 7 nM or 6 nM or even more preferably of less than 5 nM, and/or the 13B03-like ISV has a blocking activity of 4.5 μg/ml IL-17F-induced IL-6 production in human fibrosarcoma HT-1080 cells with an IC50 of less than 350 nM, more preferably, less than 300 nM, 250 nM or even less, such as less than 200 nM or 175 nM, 160 nM, or 155 nM or even more preferably of less than 150 nM and/or the 13B03-like ISV has a blocking activity of 1.5 μg/ml IL-17A/F-induced IL-6 production in human fibrosarcoma HT-1080 cells with an IC50 of less than 200 nM, more preferably, less than 150 nM, 125 nM or even less, such as less than 100 nM or 80 nM, 75 nM, 70 nM, 60 nM, 50 nM, or 40 nM or even more preferably of less than 30 nM.

For example, in a 13B03-like sequence according to this specifically preferred aspect: CDR1 is the amino acid sequence INWFG (with CDR2 and CDR3 being as defined under e) and f), respectively); and/or CDR2 is the amino acid sequence GIRWSDAYTEYANSVKG (with CDR1 and CDR3 being as defined under d) and f), respectively); and/or CDR3 is the amino acid sequence DLSTVRY (with CDR1 and CDR2 being as defined under d) and e), respectively). Particularly, when an 13B03-like sequence is according to this aspect: CDR1 is the amino acid sequence INWFG and CDR2 is the amino acid sequence GIRWSDAYTEYANSVKG (with CDR3 being as defined under f) above); and/or CDR1 is the amino acid sequence INWFG and CDR3 is the amino acid sequence DLSTVRY (with CDR2 being as defined under e) above); and/or CDR2 is the amino acid sequence GIRWSDAYTEYANSVKG and CDR3 is DLSTVRY (with CDR1 being as defined under d) above). Again, in such 13B03-like sequences, CDR1, CDR2 and CDR3 are preferably such that the 13B03-like ISV has a blocking activity, which can be determined by any suitable assay known to the person skilled in the art, such as, for instance, by means of Alphascreen assays (e.g. such as described herein) or by cell based assays (e.g. such as described herein). Preferably, the blocking activity is determined by a HT-1080 cell based assay, for instance, such as described in Example 9. Preferably, the 13B03-like ISV has a blocking activity of 0.3 μg/ml IL-17A-induced IL-6 production in human fibrosarcoma HT-1080 cells with an IC50 of less than 150 nM, more preferably, less than 100 nM, 50 nM or even less, such as less than 20 nM or 15 nM, 10 nM, 9 nM, 8 nM, 7 nM or 6 nM or even more preferably of less than 5 nM, and/or the 13B03-like ISV has a blocking activity of 4.5 μg/ml IL-17F-induced IL-6 production in human fibrosarcoma HT-1080 cells with an IC50 of less than 350 nM, more preferably, less than 300 nM, 250 nM or even less, such as less than 200 nM or 175 nM, 160 nM, or 155 nM or even more preferably of less than 150 nM and/or the 13B03-like ISV has a blocking activity of 1.5 μg/ml IL-17A/F-induced IL-6 production in human fibrosarcoma HT-1080 cells with an IC50 of less than 200 nM, more preferably, less than 150 nM, 125 nM or even less, such as less than 100 nM or 80 nM, 75 nM, 70 nM, 60 nM, 50 nM, or 40 nM or even more preferably of less than 30 nM.

In a particularly preferred 13B03-like sequence: CDR1 is the amino acid sequence INWFG, CDR2 is the amino acid sequence GIRWSDAYTEYANSVKG; and CDR3 is the amino acid sequence DLSTVRY.

In all the 13B03-like sequence described in this paragraph C), the framework sequences may be as further described herein. Preferably, the framework sequences are such that the framework sequences have at least 80%, such as at least 85%, for example at least 90%, such as at least 95% sequence identity with the framework sequences of 13B03 (which, for example, can be determined by determining the overall degree of sequence identity of a given sequence with the sequence of 13B03 while disregarding the CDR's in the calculation). Again, the combination of CDR's and frameworks present in a given sequence are preferably such that the resulting 13B03-like ISV has a blocking activity, which can be determined by any suitable assay known to the person skilled in the art, such as, for instance, by means of Alphascreen assays (e.g. such as described herein) or by cell based assays (e.g. such as described herein). Preferably, the blocking activity is determined by a HT-1080 cell based assay, for instance, such as described in Example 9. Preferably, the 13B03-like ISV has a blocking activity of 0.3 μg/ml IL-17A-induced IL-6 production in human fibrosarcoma HT-1080 cells with an IC50 of less than 150 nM, more preferably, less than 100 nM, 50 nM or even less, such as less than 20 nM or 15 nM, 10 nM, 9 nM, 8 nM, 7 nM or 6 nM or even more preferably of less than 5 nM, and/or the 13B03-like ISV has a blocking activity of 4.5 μg/ml IL-17F-induced IL-6 production in human fibrosarcoma HT-1080 cells with an IC50 of less than 350 nM, more preferably, less than 300 nM, 250 nM or even less, such as less than 200 nM or 175 nM, 160 nM, or 155 nM or even more preferably of less than 150 nM and/or the 13B03-like ISV has a blocking activity of 1.5 μg/ml IL-17A/F-induced IL-6 production in human fibrosarcoma HT-1080 cells with an IC50 of less than 200 nM, more preferably, less than 150 nM, 125 nM or even less, such as less than 100 nM or 80 nM, 75 nM, 70 nM, 60 nM, 50 nM, or 40 nM or even more preferably of less than 30 nM.

In one specific aspect, a 13B03-like sequence is an ISV that has at least 70%, such at least 80%, for example at least 85%, such as at least 90% or more than 95% sequence identity with SEQ ID NO: 662. For example, in an 13B03-like sequence according to this aspect, the CDR's may be according to the specifically preferred aspect described above, and may in particularly (but without limitation) be INWFG (CDR1); GIRWSDAYTEYANSVKG (CDR2); and DLSTVRY (CDR3). Again, preferably, the combination of CDR's and frameworks present in such a 13B03-like ISV are preferably such that the resulting 13B03-like ISV has a blocking activity, which can be determined by any suitable assay known to the person skilled in the art, such as, for instance, by means of Alphascreen assays (e.g. such as described herein) or by cell based assays (e.g. such as described herein). Preferably, the blocking activity is determined by a HT-1080 cell based assay, for instance, such as described in Example 9. Preferably, the 13B03-like ISV has a blocking activity of 0.3 μg/ml IL-17A-induced IL-6 production in human fibrosarcoma HT-1080 cells with an IC50 of less than 150 nM, more preferably, less than 100 nM, 50 nM or even less, such as less than 20 nM or 15 nM, 10 nM, 9 nM, 8 nM, 7 nM or 6 nM or even more preferably of less than 5 nM, and/or the 13B03-like ISV has a blocking activity of 4.5 μg/ml IL-17F-induced IL-6 production in human fibrosarcoma HT-1080 cells with an IC50 of less than 350 nM, more preferably, less than 300 nM, 250 nM or even less, such as less than 200 nM or 175 nM, 160 nM, or 155 nM or even more preferably of less than 150 nM and/or the 13B03-like ISV has a blocking activity of 1.5 μg/ml IL-17A/F-induced IL-6 production in human fibrosarcoma HT-1080 cells with an IC50 of less than 200 nM, more preferably, less than 150 nM, 125 nM or even less, such as less than 100 nM or 80 nM, 75 nM, 70 nM, 60 nM, 50 nM, or 40 nM or even more preferably of less than 30 nM.

In one particular aspect, any 13B03-like sequence may be a humanized and/or sequence optimized sequence, as further described herein.

In this context, one further embodiment of the invention concerns also a polypeptide comprising (i) a CDR2 having the amino acid sequence GIRWSDAYTEYANSVKG; and/or (ii) a CDR3 having the amino acid sequence DLSTVRY;

wherein the CDR2 and CDR3 sequences (i) and (ii) may in total comprise up to four single amino acid deletions, insertions and/or substitutions; and wherein the polypeptide specifically binds to IL-17A and/or IL-17F and wherein preferably the polypeptide specifically binds to IL-17A with a Kd of less than 50 pM and to IL-17F with a Kd of less than 5 nM.

Preferably the polypeptide of this embodiment specifically binds to at least one epitope of IL-17A selected from the amino acids L74, Y85 and N88 of IL-17A. Preferably the polypeptide of this embodiment specifically binds to at least three epitopes of IL-17A, e.g. at least to amino acids L74, Y85 and N88 of IL-17A (SEQ ID NO: 839).

Preferred is also a polypeptide comprising (iii) a CDR2 having the amino acid sequence GIRWSDAYTEYANSVKG; and/or (iv) a CDR3 having the amino acid sequence DLSTVRY;

wherein the CDR2 and CDR3 sequences (i) and (ii) may in total comprise up to four single amino acid deletions, insertions and/or substitutions; and wherein the polypeptide specifically binds to IL-17A and/or IL-17F (preferably each with a Kd of less than 5 nM) but not to any of IL-17B, IL-17C, IL-17D and IL-17E. Preferably, this polypeptide specifically binds to at least amino acids L74, Y85 and N88 of IL-17A (SEQ ID NO: 839). Of course also all of the above polypeptides comprising a CDR2 and/or CDR3 sequences can be used and are effective for the treatment of a disease as disclosed herein.

D) 13E02-like sequences: a “13E02-like sequence”, “13E02-like ISV” or “13E02-like building block” is defined as an ISV (as described herein) that comprises:

a) a CDR1 which comprises or essentially consists of either (i) the amino acid sequence AMG or (ii) an amino acid sequence that has 1 amino acid difference(s) (as defined herein) with the amino acid sequence AMG; and/or b) a CDR2 which comprises or essentially consists of either (i) the amino acid sequence AISGSGDDTYYADSVKG or (ii) an amino acid sequence that has at least 80%, such as at least 85%, for example at least 90% or more than 95% sequence identity with the amino acid sequence AISGSGDDTYYADSVKG; or (iii) an amino acid sequence that has only 7, 6, 5, 4, 3, 2 or 1 amino acid difference(s) (as defined herein) with the amino acid sequence AISGSGDDTYYADSVKG; and/or c) a CDR3 which comprises or essentially consists of either (i) the amino acid sequence RRGLYYVWDSNDYEN or (ii) an amino acid sequence that has at least 80%, such as at least 85%, for example at least 90% or more than 95% sequence identity with the amino acid sequence RRGLYYVWDSNDYEN; or (iii) an amino acid sequence that has only 7, 6, 5, 4, 3, 2 or 1 amino acid difference(s) (as defined herein) with the amino acid sequence RRGLYYVWDSNDYEN;

in which the framework sequences present in such an ISV are as further described herein, and in which CDR1, CDR2 and CDR3 are preferably such that the 13E02-like ISV has a blocking activity, which can be determined by any suitable assay known to the person skilled in the art, such as, for instance, by means of Alphascreen assays (e.g. such as described herein) or by cell based assays (e.g. such as described herein). Preferably, the blocking activity is determined by a HT-1080 cell based assay, for instance, such as described in Example 9. Preferably, the 13E02-like ISV has a blocking activity of 0.3 μg/ml IL-17A-induced IL-6 production in human fibrosarcoma HT-1080 cells with an IC50 of less than 150 nM, more preferably, less than 100 nM, 50 nM or even less, such as less than 20 nM or 15 nM, 10 nM, 9 nM, 8 nM, 7 nM or 6 nM or even more preferably of less than 5 nM, and/or the 13E02-like ISV has a blocking activity of 4.5 μg/ml IL-17F-induced IL-6 production in human fibrosarcoma HT-1080 cells with an IC50 of less than 350 nM, more preferably, less than 250 nM, 200 nM or even less, such as less than 175 nM or 150 nM, 140 nM, or 125 nM or even more preferably of less than 110 nM and/or the 13E02-like ISV has a blocking activity of 1.5 μg/ml IL-17A/F-induced IL-6 production in human fibrosarcoma HT-1080 cells with an IC50 of less than 200 nM, more preferably, less than 150 nM, 125 nM or even less, such as less than 100 nM or 80 nM, 75 nM, 70 nM, 60 nM, 50 nM, 40 nM or 30 nM or even more preferably of less than 25 nM. Preferably, in such a 13E02-like sequence, CDR1 and CDR2 are as defined under a) and b), respectively; or CDR1 and CDR3 are as defined under a) and c), respectively; or CDR2 and CDR3 are as defined under b) and c), respectively. More preferably, in such a 13E02-like sequence, CDR1, CDR2 and CDR3 are all as defined under a), b) and c), respectively. Again, in such an 13E02-like sequence, CDR1, CDR2 and CDR3 are preferably such that the 13E02-like ISV has a blocking activity, which can be determined by any suitable assay known to the person skilled in the art, such as, for instance, by means of Alphascreen assays (e.g. such as described herein) or by cell based assays (e.g. such as described herein). Preferably, the blocking activity is determined by a HT-1080 cell based assay, for instance, such as described in Example 9. Preferably, the 13E02-like ISV has a blocking activity of 0.3 μg/ml IL-17A-induced IL-6 production in human fibrosarcoma HT-1080 cells with an IC50 of less than 150 nM, more preferably, less than 100 nM, 50 nM or even less, such as less than 20 nM or 15 nM, 10 nM, 9 nM, 8 nM, 7 nM or 6 nM or even more preferably of less than 5 nM, and/or the 13E02-like ISV has a blocking activity of 4.5 μg/ml IL-17F-induced IL-6 production in human fibrosarcoma HT-1080 cells with an IC50 of less than 350 nM, more preferably, less than 250 nM, 200 nM or even less, such as less than 175 nM or 150 nM, 140 nM, or 125 nM or even more preferably of less than 110 nM and/or the 13E02-like ISV has a blocking activity of 1.5 μg/ml IL-17A/F-induced IL-6 production in human fibrosarcoma HT-1080 cells with an IC50 of less than 200 nM, more preferably, less than 150 nM, 125 nM or even less, such as less than 100 nM or 80 nM, 75 nM, 70 nM, 60 nM, 50 nM, 40 nM or 30 nM or even more preferably of less than 25 nM.

For example, in such an 13E02-like sequence: CDR1 may comprise or essentially consist of the amino acid sequence AMG (with CDR2 and CDR3 being as defined under b) and c), respectively); and/or CDR2 may comprise or essentially consist of the amino acid sequence AISGSGDDTYYADSVKG (with CDR1 and CDR3 being as defined under a) and c), respectively); and/or CDR3 may comprise or essentially consist of the amino acid sequence RRGLYYVWDSNDYEN (with CDR1 and CDR2 being as defined under a) and b), respectively). Particularly, when an 13E02-like sequence is according to this aspect: CDR1 may comprise or essentially consist of the amino acid sequence AMG and CDR2 may comprise or essentially consist of the amino acid sequence AISGSGDDTYYADSVKG (with CDR3 being as defined under c) above); and/or CDR1 may comprise or essentially consist of the amino acid sequence AMG and CDR3 may comprise or essentially consist of the amino acid sequence RRGLYYVWDSNDYEN (with CDR2 being as defined under b) above); and/or CDR2 may comprise or essentially consist of the amino acid sequence AISGSGDDTYYADSVKG and CDR3 may comprise or essentially consist of the amino acid sequence RRGLYYVWDSNDYEN (with CDR1 being as defined under a) above). Again, in such 13E02-like sequences, CDR1, CDR2 and CDR3 are preferably such that the 13E02-like ISV has a blocking activity, which can be determined by any suitable assay known to the person skilled in the art, such as, for instance, by means of Alphascreen assays (e.g. such as described herein) or by cell based assays (e.g. such as described herein). Preferably, the blocking activity is determined by a HT-1080 cell based assay, for instance, such as described in Example 9. Preferably, the 13E02-like ISV has a blocking activity of 0.3 μg/ml IL-17A-induced IL-6 production in human fibrosarcoma HT-1080 cells with an IC50 of less than 150 nM, more preferably, less than 100 nM, 50 nM or even less, such as less than 20 nM or 15 nM, 10 nM, 9 nM, 8 nM, 7 nM or 6 nM or even more preferably of less than 5 nM, and/or the 13E02-like ISV has a blocking activity of 4.5 μg/ml IL-17F-induced IL-6 production in human fibrosarcoma HT-1080 cells with an IC50 of less than 350 nM, more preferably, less than 250 nM, 200 nM or even less, such as less than 175 nM or 150 nM, 140 nM, or 125 nM or even more preferably of less than 110 nM and/or the 13E02-like ISV has a blocking activity of 1.5 μg/ml IL-17A/F-induced IL-6 production in human fibrosarcoma HT-1080 cells with an IC50 of less than 200 nM, more preferably, less than 150 nM, 125 nM or even less, such as less than 100 nM or 80 nM, 75 nM, 70 nM, 60 nM, 50 nM, 40 nM or 30 nM or even more preferably of less than 25 nM.

In a specifically preferred aspect, a "13E02-like sequence", "13E02-like ISV" or "13E02-like building block" is an ISV that comprises:

d) a CDR1 which is either (i) the amino acid sequence AMG or (ii) an amino acid sequence that has only 3, 2 or 1 amino acid difference(s) (as defined herein) with the amino acid sequence AMG; and/or e) a CDR2 which is either (i) the amino acid sequence AISGSGDDTYYADSVKG or (ii) an amino acid sequence that has at least 80%, such as at least 85%, for example at least 90% or more than 95% sequence identity with the amino acid sequence AISGSGDDTYYADSVKG; or (iii) an amino acid sequence that has only 7, 6, 5, 4, 3, 2 or 1 amino acid difference(s) (as defined herein) with the amino acid sequence AISGSGDDTYYADSVKG; and/or f) a CDR3 which is either (i) the amino acid sequence RRGLYYVWDSNDYEN or (ii) an amino acid sequence that has at least 80%, such as at least 85%, for example at least 90% or more than 95% sequence identity with the amino acid sequence RRGLYYVWDSNDYEN; or (iii) an amino acid sequence that has only 7, 6, 5, 4, 3, 2 or 1 amino acid difference(s) (as defined herein) with the amino acid sequence RRGLYYVWDSNDYEN;

in which the framework sequences present in such an ISV are as further described herein, and in which CDR1, CDR2 and CDR3 are preferably such that the 13E02-like ISV has a blocking activity, which can be determined by any suitable assay known to the person skilled in the art, such as, for instance, by means of Alphascreen assays (e.g. such as described herein) or by cell based assays (e.g. such as described herein). Preferably, the blocking activity is determined by a HT-1080 cell based assay, for instance, such as described in Example 9. Preferably, the 13E02-like ISV has a blocking activity of 0.3 μg/ml IL-17A-induced IL-6 production in human fibrosarcoma HT-1080 cells with an IC50 of less than 150 nM, more preferably, less than 100 nM, 50 nM or even less, such as less than 20 nM or 15 nM, 10 nM, 9 nM, 8 nM, 7 nM or 6 nM or even more preferably of less than 5 nM, and/or the 13E02-like ISV has a blocking activity of 4.5 μg/ml IL-17F-induced IL-6 production in human fibrosarcoma HT-1080 cells with an IC50 of less than 350 nM, more preferably, less than 250 nM, 200 nM or even less, such as less than 175 nM or 150 nM, 140 nM, or 125 nM or even more preferably of less than 110 nM and/or the 13E02-like ISV has a blocking activity of 1.5 μg/ml IL-17A/F-induced IL-6 production in human fibrosarcoma HT-1080 cells with an IC50 of less than 200 nM, more preferably, less than 150 nM, 125 nM or even less, such as less than 100 nM or 80 nM, 75 nM, 70 nM, 60 nM, 50 nM, 40 nM or 30 nM or even more preferably of less than 25 nM. Preferably, in a 13E02-like sequence according to this specifically preferred aspect, CDR1 and CDR2 are as defined under d) and e), respectively; or CDR1 and CDR3 are as defined under d) and f), respectively; or CDR2 and CDR3 are as defined under e) and f), respectively. More preferably, in such a 13E02-like sequence, CDR1, CDR2 and CDR3 are all as defined under d), e) and f), respectively. Again, in such an 13E02-like sequence, CDR1, CDR2 and CDR3 are preferably such that the 13E02-like ISV has a blocking activity, which can be determined by any suitable assay known to the person skilled in the art, such as, for instance, by means of Alphascreen assays (e.g. such as described herein) or by cell based assays (e.g. such as described herein). Preferably, the blocking activity is determined by a HT-1080 cell based assay, for instance, such as described in Example 9. Preferably, the 13E02-like ISV has a blocking activity of 0.3 μg/ml IL-17A-induced IL-6 production in human fibrosarcoma HT-1080 cells with an IC50 of less than 150 nM, more preferably, less than 100 nM, 50 nM or even less, such as less than 20 nM or 15 nM, 10 nM, 9 nM, 8 nM, 7 nM or 6 nM or even more preferably of less than 5 nM, and/or the 13E02-like ISV has a blocking activity of 4.5 μg/ml IL-17F-induced IL-6 production in human fibrosarcoma HT-1080 cells with an IC50 of less than 350 nM, more preferably, less than 250 nM, 200 nM or even less, such as less than 175 nM or 150 nM, 140 nM, or 125 nM or even more preferably of less than 110 nM and/or the 13E02-like ISV has a blocking activity of 1.5 μg/ml IL-17A/F-induced IL-6 production in human fibrosarcoma HT-1080 cells with an IC50 of less than 200 nM, more preferably, less than 150 nM, 125 nM or even less, such as less than 100 nM or 80 nM, 75 nM, 70 nM, 60 nM, 50 nM, 40 nM or 30 nM or even more preferably of less than 25 nM.

For example, in a 13E02-like sequence according to this specifically preferred aspect: CDR1 is the amino acid sequence AMG (with CDR2 and CDR3 being as defined under e) and f), respectively); and/or CDR2 is the amino acid sequence AISGSGDDTYYADSVKG (with CDR1 and CDR3 being as defined under d) and f), respectively); and/or CDR3 is the amino acid sequence RRGLYYVWDSNDYEN (with CDR1 and CDR2 being as defined under d) and e), respectively). Particularly, when an 13E02-like sequence is according to this aspect: CDR1 is the amino acid sequence AMG and CDR2 is the amino acid sequence AISGSGDDTYYADSVKG (with CDR3 being as defined under f) above); and/or CDR1 is the amino acid sequence AMG and CDR3 is the amino acid sequence RRGLYYVWDSNDYEN (with CDR2 being as defined under e) above); and/or CDR2 is the amino acid sequence AISGSGDDTYYADSVKG and CDR3 is RRGLYYVWDSNDYEN (with CDR1 being as defined under d) above). Again, in such 13E02-like sequences, CDR1, CDR2 and CDR3 are preferably such that the 13E02-like ISV has a blocking activity, which can be determined by any suitable assay known to the person skilled in the art, such as, for instance, by means of Alphascreen assays (e.g. such as described herein) or by cell based assays (e.g. such as described herein). Preferably, the blocking activity is determined by a HT-1080 cell based assay, for instance, such as described in Example 9. Preferably, the 13E02-like ISV has a blocking activity of 0.3 μg/ml IL-17A-induced IL-6 production in human fibrosarcoma HT-1080 cells with an IC50 of less than 150 nM, more preferably, less than 100 nM, 50 nM or even less, such as less than 20 nM or 15 nM, 10 nM, 9 nM, 8 nM, 7 nM or 6 nM or even more preferably of less than 5 nM, and/or the 13E02-like ISV has a blocking activity of 4.5 μg/ml IL-17F-induced IL-6 production in human fibrosarcoma HT-1080 cells with an IC50 of less than 350 nM, more preferably, less than 250 nM, 200 nM or even less, such as less than 175 nM or 150 nM, 140 nM, or 125 nM or even more preferably of less than 110 nM and/or the 13E02-like ISV has a blocking activity of 1.5 μg/ml IL-17A/F-induced IL-6 production in human fibrosarcoma HT-1080 cells with an IC50 of less than 200 nM, more preferably, less than 150 nM, 125 nM or even less, such as less than 100 nM or 80 nM, 75 nM, 70 nM, 60 nM, 50 nM, 40 nM or 30 nM or even more preferably of less than 25 nM.

In a particularly preferred 13E02-like sequence: CDR1 is the amino acid sequence AMG, CDR2 is the amino acid sequence AISGSGDDTYYADSVKG; and CDR3 is the amino acid sequence RRGLYYVWDSNDYEN.

In all the 13E02-like sequence described in this paragraph D), the framework sequences may be as further described herein. Preferably, the framework sequences are such that the framework sequences have at least 80%, such as at least 85%, for example at least 90%, such as at least 95% sequence identity with the framework sequences of 13E02 (which, for example, can be determined by determining the overall degree of sequence identity of a given sequence with the sequence of 13E02 while disregarding the CDR's in the calculation). Again, the combination of CDR's and frameworks present in a given sequence are preferably such that the resulting 13E02-like ISV has a blocking activity, which can be determined by any suitable assay known to the person skilled in the art, such as, for instance, by means of Alphascreen assays (e.g. such as described herein) or by cell based assays (e.g. such as described herein). Preferably, the blocking activity is determined by a HT-1080 cell based assay, for instance, such as described in Example 9. Preferably, the 13E02-like ISV has a blocking activity of 0.3 μg/ml IL-17A-induced IL-6 production in human fibrosarcoma HT-1080 cells with an IC50 of less than 150 nM, more preferably, less than 100 nM, 50 nM or even less, such as less than 20 nM or 15 nM, 10 nM, 9 nM, 8 nM, 7 nM or 6 nM or even more preferably of less than 5 nM, and/or the 13E02-like ISV has a blocking activity of 4.5 μg/ml IL-17F-induced IL-6 production in human fibrosarcoma HT-1080 cells with an IC50 of less than 350 nM, more preferably, less than 250 nM, 200 nM or even less, such as less than 175 nM or 150 nM, 140 nM, or 125 nM or even more preferably of less than 110 nM and/or the 13E02-like ISV has a blocking activity of 1.5 μg/ml IL-17A/F-induced IL-6 production in human fibrosarcoma HT-1080 cells with an IC50 of less than 200 nM, more preferably, less than 150 nM, 125 nM or even less, such as less than 100 nM or 80 nM, 75 nM, 70 nM, 60 nM, 50 nM, 40 nM or 30 nM or even more preferably of less than 25 nM.

In one specific aspect, a 13E02-like sequence is an ISV that has at least 70%, such at least 80%, for example at least 85%, such as at least 90% or more than 95% sequence identity with SEQ ID NO: 664. For example, in an 13E02-like sequence according to this aspect, the CDR's may be according to the specifically preferred aspect described above, and may in particularly (but without limitation) be AMG (CDR1); AISGSGDDTYYADSVKG (CDR2); and RRGLYYVWDSNDYEN (CDR3). Again, preferably, the combination of CDR's and frameworks present in such a 13E02-like ISV are preferably such that the resulting 13E02-like ISV has a blocking activity, which can be determined by any suitable assay known to the person skilled in the art, such as, for instance, by means of Alphascreen assays (e.g. such as described herein) or by cell based assays (e.g. such as described herein). Preferably, the blocking activity is determined by a HT-1080 cell based assay, for instance, such as described in Example 9. Preferably, the 13E02-like ISV has a blocking activity of 0.3 μg/ml IL-17A-induced IL-6 production in human fibrosarcoma HT-1080 cells with an IC50 of less than 150 nM, more preferably, less than 100 nM, 50 nM or even less, such as less than 20 nM or 15 nM, 10 nM, 9 nM, 8 nM, 7 nM or 6 nM or even more preferably of less than 5 nM, and/or the 13E02-like ISV has a blocking activity of 4.5 μg/ml IL-17F-induced IL-6 production in human fibrosarcoma HT-1080 cells with an IC50 of less than 350 nM, more preferably, less than 250 nM, 200 nM or even less, such as less than 175 nM or 150 nM, 140 nM, or 125 nM or even more preferably of less than 110 nM and/or the 13E02-like ISV has a blocking activity of 1.5 μg/ml IL-17A/F-induced IL-6 production in human fibrosarcoma HT-1080 cells with an IC50 of less than 200 nM, more preferably, less than 150 nM, 125 nM or even less, such as less than 100 nM or 80 nM, 75 nM, 70 nM, 60 nM, 50 nM, 40 nM or 30 nM or even more preferably of less than 25 nM.

In one particular aspect, any 13E02-like sequence may be a humanized and/or sequence optimized sequence, as further described herein.

In this context, one further embodiment of the invention concerns also a polypeptide comprising (i) a CDR2 having the amino acid sequence AISGSGDDTYYADSVKG; and/or (ii) a CDR3 having the amino acid sequence RRGLYYVWDANDYEN;

wherein the CDR2 and CDR3 sequences (i) and (ii) may in total comprise up to four single amino acid deletions, insertions and/or substitutions; and wherein the polypeptide specifically binds to IL-17A and/or IL-17F and wherein preferably the polypeptide specifically binds to IL-17A with a Kd of less than 50 pM and to IL-17F with a Kd of less than 5 nM.

Preferably the polypeptide of this embodiment specifically binds to at least one epitope of IL-17A selected from the amino acids L74, Y85 and N88 of IL-17A. Preferably the polypeptide of this embodiment specifically binds to at least three epitopes of IL-17A, e.g. at least to amino acids L74, Y85 and N88 of IL-17A (SEQ ID NO: 839).

Preferred is also a polypeptide comprising (iii) a CDR2 having the amino acid sequence AISGSGDDTYYADSVKG; and/or (iv) a CDR3 having the amino acid sequence RRGLYYVWDANDYEN;

wherein the CDR2 and CDR3 sequences (i) and (ii) may in total comprise up to four single amino acid deletions, insertions and/or substitutions; and wherein the polypeptide specifically binds to IL-17A and/or IL-17F (preferably each with a Kd of less than 5 nM) but not to any of IL-17B, IL-17C, IL-17D and IL-17E. Preferably, this polypeptide specifically binds to at least amino acids L74, Y85 and N88 of IL-17A (SEQ ID NO: 839).

Of course also all of the above polypeptides comprising a CDR2 and/or CDR3 sequences can be used and are effective for the treatment of a disease as disclosed herein. As mentioned, a polypeptide of the invention preferably specifically binds to at least three epitopes of IL-17A and/or IL-17F, e.g.

(i) at least to amino acids L74, Y85 and N88 of IL-17A (SEQ ID NO: 839);

(ii) at least to amino acids H54, L74 and Y85 of IL-17A (SEQ ID NO: 839); and/or (iii) at least to amino acids R47, R73, I86 and N89 of IL-17F (SEQ ID NO: 840).

As further described herein, but without being limited to any explanation, mechanism of action or hypothesis, in the present invention, four different classes of amino acid sequences of the invention have been identified, based on their ability to inhibit the interaction of IL-17A, IL-17F or IL-171F with either or both of the receptors IL-17RA or IL-17RC complex (in particular in the Alphascreen assay described in Example 5 below). These four classes of amino acid sequences of the invention are (defined herein as follows):

"Class 1 amino acid sequence": an amino acid sequence of the invention (and in particular an ISV as described herein) that is capable of inhibiting the interaction of IL-17A with (at least one of, and most preferably both of) the receptors IL-17RA or IL-17RC of the receptor complex, but that is essentially not capable of inhibiting the interaction of IL-17A/F interaction with either of IL-17RA or IL-17RC. Some specific but non-limiting examples of Class 1 amino acid sequences are given in the further description herein (see for example Tables 5-8);

"Class 2 amino acid sequence": an amino acid sequence of the invention (and in particular an ISV as described herein) that is capable of inhibiting the interaction of both IL-17A and of IL-17A/F with (at least one of, and most preferably both of) the receptors IL-17RA or IL-17RC of the receptor complex. Some specific but non-limiting examples of Class 2 amino acid sequences are given in the further description herein (see for example Tables 5-8). Some preferred, but non-limiting examples of Class 2 amino acid sequences of the invention are the "04G01-like sequences" (as defined herein), with humanized and/or sequence-optimized variants of 04G01 (see for example Tables 23 and 24) being particularly preferred;

"Class 3 amino acid sequence": an amino acid sequence of the invention (and in particular an ISV as described herein) that is capable of inhibiting the interaction of IL-17F with (at least one of, and most preferably both of) the receptors IL-17RA or IL-17RC of the receptor complex. Class 3 amino acid sequences of the invention may also be capable of (at least partially) inhibiting the interaction of IL-17A/F with (at least one of, and most preferably both of) the receptors IL-17RA or IL-17RC of the receptor complex. Some specific but non-limiting examples of Class 3 amino acid sequences are given in the further description herein (see for example Tables 5-8). Some preferred, but non-limiting examples of Class 3 amino acid sequences of the invention are the "16A04-like sequences" (as defined herein), with humanized and/or sequence-optimized variants of 16A04 (such as for example IL17MS3063, see Table 30) being particularly preferred. In some preferred, but non-limiting examples, Class 3 amino acid sequences are directed against and/or bind to R47, R73, I86 and/or N89 of hIL-17F, including combinations thereof (see for example Table 11);

"Class 4 amino acid sequence" (also referred to herein as a "cross-reactive amino acid sequence" and also indicated with an "X"): an amino acid sequence of the invention (and in particular an ISV as described herein) that is capable of inhibiting the interaction of both IL-17A and IL-17F, hence including IL-17A/F, with (at least one of, and most preferably both of) the receptors IL-17RA or IL-17RC of the receptor complex. Some preferred, but non-limiting examples of Class 4 amino acid sequences of the invention are the "13B03-like sequences" (as defined herein) and the "13E02-like sequences" (also as defined herein), with humanized and/or sequence-optimized variants of 13603 (such as for example IL17MS3068, see e.g. Table 26) and 13E02 (such as for example IL17MS3069 and IL17MS3070, see Table 28), respectively, being particularly preferred. In some preferred, but non-limiting examples, Class 4 amino acid sequences are directed against and/or bind to L74, Y85 and/or N88 of hIL-17A (see for example Table 11).

TABLE A-0

Overview anti-IL-17 blocking specificity of Nanobody classes

| Nanobody | | Blocking activity[1)] | | |
|---|---|---|---|---|
| Class | Example | IL-17A | IL-17F | IL-17A/F |
| Class 1 | | YES | Essentially NO | NO |
| Class 2 | 04G01 | YES | NO | YES |
| Class 3 | 16A04 | NO | YES | Partially YES |
| Class 4 | 13E02, 13B03 | YES | YES | YES |

[1)]Blocking activity as determined by IL-17A, IL-17F and IL-17A/F-induced IL-6 production in human fibrosarcoma HT-1080 cells as described above Each of these classes of amino acid sequences of the invention (and in particular, ISV's belonging to each of these classes), form further aspects of the invention. Generally, and although the invention is not limited to the same, (the use as building blocks of) Class 2 amino acid sequences are more preferred than Class 1 amino acid sequences, and (the use as building blocks of) Class 3 and/or Class 4 amino acid sequences are in turn more preferred than Class 2 amino acid sequences.

Preferred but non-limiting examples of ISV's of the invention belonging to each of these Classes are given in the examples herein.

Also, as further described herein, one of the advantages of the invention is that the amino acid sequences of the invention (and in particular, the ISV's of the invention) can be used as building blocks to provide the compounds, constructs, proteins and polypeptides of the invention. In this way, for example and without limitation, the invention also makes it possible to combine amino acid sequences of the invention (and in particular ISV's of the invention) that belong to different Classes into a single compound, construct, protein or polypeptide of the invention. In particular, it was shown that combining Class 3 ISV's with Class 4 ISV's into a single compound, construct, protein or polypeptide of the invention have unique binding properties (cf. Example 29).

As further described herein, such compounds, constructs, proteins or polypeptides of the invention may for example and without limitation comprise or essentially consist of:

an amino acid sequence of the invention (and in particular, an ISV of the invention) and one or more (such as one or two) other groups, residues, moieties or binding units (as further described herein, for example a group, residue, moiety or binding unit that increases the half-life of the amino acid sequence of the invention), which are linked to each other either directly or preferably via one or more suitable linkers (as further described herein);

two or more (such as two or three) amino acid sequences of the invention (which may be the same or different), and in particular two or more (such as two or three) ISV's of the invention (which again may be the same or different), and optionally one or more (such as one or two) other groups, residues, moieties or binding units (as further described herein, for example a group, residue, moiety or binding unit that increases the half-life of the amino acid sequence(s) of the invention), which are linked to each other either directly or preferably via one or more suitable linkers (as further described herein).

Also, as further described herein, when a compound, construct, protein or polypeptide of the invention comprises one or more one or more (such as one or two) other groups, residues, moieties or binding units, these are preferably (but without limitation) either (i) one or more other immunoglobulin single variable domains (for example, directed to a target other than IL-17A, IL-17F or IL-17A/F, i.e. so as to provide a multispecific protein or polypeptide of the invention) and/or (ii) a group, residue, moiety or binding unit that increases the half-life of the amino acid sequence(s) of the invention, which may for example be a group, residue, moiety or binding unit that is directed to a serum protein such as (human) serum albumin (for example, an ISV that is directed to a serum protein and in particular to serum albumin, or a peptide that is directed to a serum protein and in particular to serum albumin, as further described herein).

Thus, for example and without limitation, such compounds, constructs, proteins or polypeptides of the invention may comprise or essentially consist of:

An amino acid sequence of the invention (and in particular, an ISV of the invention) belonging to Class 1 (as defined herein), and a group, residue, moiety or binding unit that increases the half-life of said amino acid sequence (and preferably an ISV that is directed to a serum protein and in particular to serum albumin, or a peptide that is directed to a serum protein and in particular to serum albumin), optionally suitably linked via one or more suitable linkers.

An amino acid sequence of the invention (and in particular, an ISV of the invention) belonging to Class 2 (as defined herein), and a group, residue, moiety or binding unit that increases the half-life of said amino acid sequence (and preferably an ISV that is directed to a serum protein and in particular to serum albumin, or a peptide that is directed to a serum protein and in particular to serum albumin), optionally suitably linked via one or more suitable linkers.

An amino acid sequence of the invention (and in particular, an ISV of the invention) belonging to Class 3 (as defined herein), and a group, residue, moiety or binding unit that increases the half-life of said amino acid sequence (and preferably an ISV that is directed to a serum protein and in particular to serum albumin, or a peptide that is directed to a serum protein and in particular to serum albumin), optionally suitably linked via one or more suitable linkers.

An amino acid sequence of the invention (and in particular, an ISV of the invention) belonging to Class 4 (as defined herein), and a group, residue, moiety or binding unit that increases the half-life of said amino acid sequence (and preferably an ISV that is directed to a serum protein and in particular to serum albumin, or a peptide that is directed to a serum protein and in particular to serum albumin), optionally suitably linked via one or more suitable linkers.

Two amino acid sequences of the invention (and in particular, two ISV's of the invention) both belonging to Class 1 (as defined herein), and a group, residue, moiety or binding unit that increases the half-life of said amino acid sequence (and preferably an ISV that is directed to a serum protein and in particular to serum albumin, or a peptide that is directed to a serum protein and in particular to serum albumin), optionally suitably linked via one or more suitable linkers.

Two amino acid sequences of the invention (and in particular, two ISV's of the invention) both belonging to Class 2 (as defined herein), and a group, residue, moiety or binding unit that increases the half-life of said amino acid sequence (and preferably an ISV that is directed to a serum protein and in particular to serum albumin, or a peptide that is directed to a serum protein and in particular to serum albumin), optionally suitably linked via one or more suitable linkers.

Two amino acid sequences of the invention (and in particular, two ISV's of the invention) both belonging to Class 3 (as defined herein), and a group, residue, moiety or binding unit that increases the half-life of said amino acid sequence (and preferably an ISV that is directed to a serum protein and in particular to serum albumin, or a peptide that is directed to a serum protein and in particular to serum albumin), optionally suitably linked via one or more suitable linkers.

Two amino acid sequences of the invention (and in particular, two ISV's of the invention) both belonging to Class 4 (as defined herein), and a group, residue, moiety or binding unit that increases the half-life of said amino acid sequence (and preferably an ISV that is directed to a serum protein and in particular to serum albumin, or a peptide that is directed to a serum protein and in particular to serum albumin), optionally suitably linked via one or more suitable linkers.

An amino acid sequence of the invention (and in particular, an ISV of the invention) belonging to Class 1 (as defined herein), an amino acid sequence of the invention (and in particular, an ISV of the invention) belonging to Class 2 (as defined herein), and a group, residue, moiety or binding unit that increases the half-life of said amino acid sequence (and preferably an ISV that is directed to a serum protein and in particular to serum albumin, or a peptide that is directed to a serum protein and in particular to serum albumin), optionally suitably linked via one or more suitable linkers.

An amino acid sequence of the invention (and in particular, an ISV of the invention) belonging to Class 1 (as defined herein), an amino acid sequence of the invention (and in particular, an ISV of the invention) belonging to Class 3 (as defined herein), and a group, residue, moiety or binding unit that increases the half-life of said amino acid sequence (and preferably an ISV that is directed to a serum protein and in particular to serum albumin, or a peptide that is directed to a serum protein and in particular to serum albumin), optionally suitably linked via one or more suitable linkers.

An amino acid sequence of the invention (and in particular, an ISV of the invention) belonging to Class 1 (as defined herein), an amino acid sequence of the invention (and in particular, an ISV of the invention) belonging to Class 4 (as defined herein), and a group, residue, moiety or binding unit that increases the half-life of said amino acid sequence (and preferably an ISV that is directed to a serum protein and in particular to serum albumin, or a peptide that is directed to a serum protein and in particular to serum albumin), optionally suitably linked via one or more suitable linkers.

An amino acid sequence of the invention (and in particular, an ISV of the invention) belonging to Class 2 (as defined herein), an amino acid sequence of the invention (and in particular, an ISV of the invention) belonging to Class 3 (as defined herein), and a group, residue, moiety or binding unit that increases the half-life of said amino acid sequence (and preferably an ISV that is directed to a serum protein and in particular to serum albumin, or a peptide that is directed to a serum protein and in particular to serum albumin), optionally suitably linked via one or more suitable linkers.

An amino acid sequence of the invention (and in particular, an ISV of the invention) belonging to Class 2 (as defined herein), an amino acid sequence of the invention (and in particular, an ISV of the invention) belonging to Class 4 (as defined herein), and a group, residue, moiety or binding unit that increases the half-life of said amino acid sequence (and preferably an ISV that is directed to a serum protein and in particular to serum albumin, or a peptide that is directed to a serum protein and in particular to serum albumin), optionally suitably linked via one or more suitable linkers.

An amino acid sequence of the invention (and in particular, an ISV of the invention) belonging to Class 3 (as defined herein), an amino acid sequence of the invention (and in particular, an ISV of the invention) belonging to Class 4 (as defined herein), and a group, residue, moiety or binding unit that increases the half-life of said amino acid sequence (and preferably an ISV that is directed to a serum protein and in particular to serum albumin, or a peptide that is directed to a serum protein and in particular to serum albumin), optionally suitably linked via one or more suitable linkers.

Each of the above compounds, constructs, proteins or polypeptides of the invention form further aspects of the invention.

When one of the compounds, constructs, proteins or polypeptides of the invention (such as one of the compounds, constructs, proteins or polypeptides of the invention according to one of the preceding paragraphs) comprises a Class 2 sequence, it is preferably a 04G01-like sequence (as defined herein), and more preferably a humanized and/or sequence-optimized variant of 04G01. Thus, a further aspect of the invention is a compound, construct, protein or polypeptide of the invention as described herein (and in particular, as described in the preceding paragraphs) that comprises a Class 2 amino acid sequence, wherein said Class 2 amino acid sequence is a 04G01-like sequence (as defined herein), and more preferably a humanized and/or sequence-optimized variant of 04G01.

When one of the compounds, constructs, proteins or polypeptides of the invention (such as one of the compounds, constructs, proteins or polypeptides of the invention according to one of the preceding paragraphs) comprises a Class 3 sequence, it is preferably a 16A04-like sequence (as defined herein), and more preferably a humanized and/or sequence-optimized variant of 16A04. Thus, a further aspect of the invention is a compound, construct, protein or polypeptide of the invention as described herein (and in particular, as described in the preceding paragraphs) that comprises a Class 3 amino acid sequence, wherein said Class 3 amino acid sequence is a 16A04-like sequence (as defined herein), and more preferably a humanized and/or sequence-optimized variant of 16A04.

When one of the compounds, constructs, proteins or polypeptides of the invention (such as one of the compounds, constructs, proteins or polypeptides of the invention according to one of the preceding paragraphs) comprises a Class 4 sequence, it is preferably a 13B03-like sequence (as defined herein), and more preferably a humanized and/or sequence-optimized variant of 13B03, or a 13E02-like sequence (as defined herein), and more preferably a humanized and/or sequence-optimized variant of 13E02. Thus, a further aspect of the invention is a compound, construct, protein or polypeptide of the invention as described herein (and in particular, as described in the preceding paragraphs) that comprises a Class 4 amino acid sequence, wherein said Class 4 amino acid sequence is a 13B03-like sequence (as defined herein), and more preferably a humanized and/or sequence-optimized variant of 13B03, and/or a 13E02-like sequence (as defined herein), and more preferably a humanized and/or sequence-optimized variant of 13E02.

Some preferred, but non-limiting examples of some of these compounds, constructs, proteins or polypeptides of the invention are described in the examples below. Based on the disclosure herein, the skilled person will also be able to provide other such compounds, constructs, proteins or polypeptides of the invention, for example by suitably combining one or more suitable amino acid sequences of the invention (such as those described in the examples below) with a group, residue, moiety or binding unit that increases the half-life of said amino acid sequence (such as an ISV or small peptide that is directed against (human) serum albumin, as further described herein).

Particularly preferred are compounds, constructs, proteins or polypeptides of the invention may comprise or essentially consist of:

An amino acid sequence of the invention (and in particular, an ISV of the invention) belonging to Class 3 (as defined herein), an amino acid sequence of the invention (and in particular, an ISV of the invention) belonging to Class 4 (as defined herein), and a group, residue, moiety or binding unit that increases the half-life of said amino acid sequence (and preferably an ISV that is directed to a serum protein and in particular to serum albumin, or a peptide that is directed to a serum protein and in particular to serum albumin), optionally suitably linked via one or more suitable linkers. As further described herein, such a compound, construct, protein or polypeptide of the invention preferably comprises a "13B03-like sequence" (as defined herein, and more preferably a humanized and/or sequence-optimized variant of 13B03) or a "13E02-like sequence" (as defined herein, and more preferably a humanized and/or sequence-optimized variant of 13E02) as the Class 4 sequence and a "16A04-like sequence" (as defined herein, and more preferably a humanized and/or sequence-optimized variant of 16A04) as the Class 3 sequence. Some specifically preferred, but non-limiting examples of these compounds, constructs, proteins or polypeptides of the invention are IL17MS3084, IL17MS3085, IL17MS3086 and IL17MS3087 (see Example 26 and Table 33). Other examples of such/similar compounds, constructs, proteins or polypeptides of the invention will be clear to the skilled person based on the disclosure herein.

Two amino acid sequences of the invention (and in particular, two ISV's of the invention) both belonging to Class 4 (as defined herein), and a group, residue, moiety or binding unit that increases the half-life of said amino acid sequence (and preferably an ISV that is directed to a serum protein and in particular to serum albumin, or a peptide that is directed to a serum protein and in particular to serum albumin), optionally suitably linked via one or more suitable linkers. As further described herein, such a compound, construct, protein or polypeptide of the invention preferably comprises two "13B03-like sequences" (as defined herein, and more preferably two humanized and/or sequence-optimized variants of 13B03), which may be the same or different, or two "13E02-like sequences" (as defined herein, and more preferably a humanized and/or sequence-optimized variant of 13E02), which again may be the same or different, with compounds, constructs, proteins or polypeptides of the invention that comprise or essentially consist of two "13B03-like sequences" being particularly preferred. A specifically preferred, but non-limiting example of such a polypeptide of the invention is IL17MS3079 (see Example 26 and Table 33). Other examples of such/similar compounds, constructs, proteins or polypeptides of the invention will be clear to the skilled person based on the disclosure herein.

Some specifically preferred but non-limiting compounds, constructs, proteins or polypeptides of the invention may comprise or essentially consist of:

Two "13B03-like sequences" (as defined herein, and more preferably two humanized and/or sequence-optimized variants of 13B03), which may be the same or different (and are preferably the same) and one ISV against human serum albumin or a peptide directed to human serum albumin, optionally suitably linked via one or more suitable linkers (as described herein);

A "13B03-like sequence" (as defined herein, and more preferably a humanized and/or sequence-optimized variant of 13B03), a "16A04-like sequence" (as defined herein, and more preferably a humanized and/or sequence-optimized variant of 16A04) and one ISV against human serum albumin or a peptide directed to human serum albumin, optionally suitably linked via one or more suitable linkers (as described herein);

A "13E02-like sequence" (as defined herein, and more preferably a humanized and/or sequence-optimized variant of 13E02), a "16A04-like sequence" (as defined herein, and more preferably a humanized and/or sequence-optimized variant of 16A04) and one ISV against human serum albumin or a peptide directed to human serum albumin, optionally suitably linked via one or more suitable linkers (as described herein).

Again, some specific but non-limiting examples of such compounds, constructs, proteins or polypeptides of the invention are given herein (see for example Table 34) or will be clear to the skilled person based on the disclosure herein.

Preferably, the compounds, constructs, proteins or polypeptides of the invention have a blocking activity, which can be determined by any suitable assay known to the person skilled in the art, such as, for instance, by means of Alphascreen assays (e.g. such as described herein) or by cell based assays (e.g. such as described herein). Preferably, the blocking activity is determined by a HT-1080 cell based assay, for instance, such as described in Example 9.

In particular, compounds, constructs, proteins or polypeptides of the invention comprising an amino acid sequence of the invention (and in particular, an ISV of the invention) belonging to Class 1 (as defined herein), said compounds, constructs, proteins or polypeptides preferably have a blocking activity of 0.3 μg/ml IL-17A-induced IL-6 production in human fibrosarcoma HT-1080 cells with an IC50 of less than 150 nM, more preferably, less than 100 nM, 50 nM or even less, such as less than 20 nM, 18 nM, 16 nM, 15 nM, 14 nM, 13 nM, 12 nM, or 11 nM or even more preferably of less than 10 nM.

In particular, compounds, constructs, proteins or polypeptides of the invention comprising an amino acid sequence of the invention (and in particular, an ISV of the invention) belonging to Class 2 (as defined herein), said compounds, constructs, proteins or polypeptides preferably have a blocking activity of 0.3 μg/ml IL-17A-induced IL-6 production in human fibrosarcoma HT-1080 cells with an IC50 of less than 150 nM, more preferably, less than 100 nM, 50 nM or even less, such as less than 20 nM or 15 nM, 10 nM, 9 nM, 8 nM, 7 nM or 6 nM or even more preferably of less than 5 nM and/or said compounds, constructs, proteins or polypeptides have a blocking activity of 1.5 μg/ml IL-17A/F-induced IL-6 production in human fibrosarcoma HT-1080 cells with an IC50 of less than 250 nM, more preferably, less than 200 nM, 150 nM or even less, such as less than 100 nM or 80 nM, 75 nM, 70 nM, 60 nM, 50 nM, or 40 nM or even more preferably of less than 35 nM.

In particular, compounds, constructs, proteins or polypeptides of the invention comprising an amino acid sequence of the invention (and in particular, an ISV of the invention) belonging to Class 3 (as defined herein), said compounds, constructs, proteins or polypeptides preferably have a blocking activity of 0.3 μg/ml IL-17A-induced IL-6 production in human fibrosarcoma HT-1080 cells with an IC50 of less than 150 nM, more preferably, less than 100 nM, 50 nM or even less, such as less than 20 nM or 15 nM, 10 nM, 9 nM, 8 nM, 7 nM or 6 nM or even more preferably of less than 5 nM and/or said compounds, constructs, proteins or polypeptides have a blocking activity of 1.5 μg/mL-17A/F-induced IL-6 production in human fibrosarcoma HT-1080 cells with an IC50 of less than 250 nM, more preferably, less than 200 nM, 150 nM or even less, such as less than 100 nM or 80 nM, 75 nM, 70 nM, 60 nM, 50 nM, or 40 nM or even more preferably of less than 35 nM.

In particular, compounds, constructs, proteins or polypeptides of the invention comprising an amino acid sequence of the invention (and in particular, an ISV of the invention) belonging to Class 4 (as defined herein), said compounds, constructs, proteins or polypeptides preferably have a blocking activity of 0.3 μg/ml IL-17A-induced IL-6 production in human fibrosarcoma HT-1080 cells with an IC50 of less than 150 nM, more preferably, less than 100 nM, 50 nM or even less, such as less than 20 nM or 15 nM, 10 nM, 9 nM, 8 nM, 7 nM or 6 nM or even more preferably of less than 5 nM, and/or the said compounds, constructs, proteins or polypeptides have a blocking activity of 4.5 μg/ml IL-17F-induced IL-6 production in human fibrosarcoma HT-1080 cells with an IC50 of less than 350 nM, more preferably, less than 250 nM, 200 nM or even less, such as less than 175 nM or 150 nM, 140 nM, or 125 nM or even more preferably of less than 110 nM and/or said compounds, constructs, proteins or polypeptides have a blocking activity of 1.5 μg/ml IL-17A/F-induced IL-6 production in human fibrosarcoma HT-1080 cells with an IC50 of less than 200 nM, more preferably, less than 150 nM, 125 nM or even less, such as less than 100 nM or 80 nM, 75 nM, 70 nM, 60 nM, 50 nM, 40 nM or 30 nM or even more preferably of less than 25 nM.

It will be appreciated by the person skilled in the art that the blocking activity of the compounds, constructs, proteins or polypeptides of the invention, which comprise more than one (building block of) Class 1, 2, 3 or 4 amino acid sequences, can be determined according to any of the assays as described above, wherein said compounds, constructs, proteins or polypeptides of the invention preferably have a blocking activity similarly to the blocking activity of each of its constituents, i.e. a blocking activity similarly to the blocking activity of each of the (building blocks of) Class 1, 2, 3 or 4 amino acid sequences comprised in said compounds, constructs, proteins or polypeptides of the invention. Some specific but non-limiting examples of the above-mentioned preferred compounds, constructs, proteins or polypeptides of the invention are:

Compounds, constructs, proteins or polypeptides that have at least 80% sequence identity (as defined herein) with a sequence selected from the group consisting of SEQ ID NO:s 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693.

Compounds, constructs, proteins or polypeptides that have at least 85% sequence identity (as defined herein) with a sequence selected from the group consisting of SEQ ID NO:s 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693.

Compounds, constructs, proteins or polypeptides that have at least 90% sequence identity (as defined herein) with a sequence selected from the group consisting of SEQ ID NO:s 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693.

Compounds, constructs, proteins or polypeptides that have at least 95% sequence identity (as defined herein) with a sequence selected from the group consisting of SEQ ID NO:s 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693.

Compounds, constructs, proteins or polypeptides that consists of two 13B03-like sequences which may be the same or different in which each 13B03-like sequence is independently chosen from IL17MS3067 or IL17MS3068, and further consists of one ISV against human serum albumin or a peptide directed to human serum albumin (such as Alb-8/Alb-11); all optionally suitably linked via one or more suitable linkers (as described herein). A specific preferred but-non-limiting example of such a polypeptide is IL17MS3079.

Compounds, constructs, proteins or polypeptides that consists of a 13B03-like sequence that is independently chosen from IL17MS3067 or IL17MS3068, a 16A04-like sequence that is independently chosen from IL17MS3063 (or IL17MS3063 without the E1D substitution) and one ISV against human serum albumin or a peptide directed to human serum albumin (such as Alb-8/Alb-11), optionally suitably linked via one or more suitable linkers (as described herein). Specific preferred but-non-limiting examples of such polypeptides are IL17MS3084 and IL17MS3085.

Compounds, constructs, proteins or polypeptides that consists of a 13E02-like sequence that is independently chosen from IL17MS3069 or IL17MS3070, a 16A04-like sequence that is independently chosen from IL17MS3063 (or IL17MS3063 without the E1D substitution) and one ISV against human serum albumin or a peptide directed to human serum albumin (such as Alb-8/Alb-11), optionally suitably linked via one or more suitable linkers (as described herein). Specific preferred but-non-limiting examples of such polypeptides are IL17MS3086, IL17MS3087 and IL17MS3091.

Compounds, constructs, proteins or polypeptides that have at least 80%, such as at least 85%, preferably at least 90% sequence identity (as defined herein) with IL17MS3079. Preferably, the compounds, constructs, proteins or polypeptides that have at least 80%, such as at least 85%, preferably at least 90% sequence identity (as defined herein) with IL17MS3079 have a blocking activity, which can be determined by any suitable assay known to the person skilled in the art, such as, for instance, by means of Alphascreen assays (e.g. such as described herein) or by cell based assays (e.g. such as described herein). Preferably, the blocking activity is determined by a HT-1080 cell based assay, for instance, such as described in Example 26. Preferably, said compounds, constructs, proteins or polypeptides that have at least 80%, such as at least 85%, preferably at least 90% sequence identity (as defined herein) with IL17MS3079 have a blocking activity of 1 nM IL-17A-induced IL-6 production in human fibrosarcoma HT-1080 cells with an IC50 of less than 150 nM, more preferably, less than 100 nM, 50 nM or even less, such as less than 20 nM or 15 nM, 10 nM, 9 nM, 8 nM, 7 nM or 6 nM or even more preferably of less than 5 nM, such as 4 nM, 3 nM, 2 nM or even less than 1 nM and/or said compounds, constructs, proteins or polypeptides that have at least 80%, such as at least 85%, preferably at least 90% sequence identity (as defined herein) with IL17MS3079 have a blocking activity of 15 nM IL-17F induced IL-6 production in human fibrosarcoma HT-1080 cells with an IC50 of less than 100 nM, more preferably, less than 75 nM, 50 nM or even less, such as less than 40 nM or 30 nM, 25 nM, 20 nM, 15 nM or even more preferably of less than 10 nM and/or said compounds, constructs, proteins or polypeptides that have at least 80%, such as at least 85%, preferably at least 90% sequence identity (as defined herein) with IL17MS3079 have a blocking activity of 5 nM IL-17A/F-induced IL-6 production in human fibrosarcoma HT-1080 cells with an IC50 of less than 150 nM, more preferably, less than 100 nM, 50 nM or even less, such as less than 20 nM or 15 nM, 10 nM, 9 nM, 8 nM, 7 nM or 6 nM or even more preferably of less than 5 nM, such as 4 nM, or 3 nM, or even less than 2 nM.

Compounds, constructs, proteins or polypeptides that have at least 80%, such as at least 85%, preferably at least 90% sequence identity (as defined herein) with IL17MS3084 Preferably, the compounds, constructs, proteins or polypeptides that have at least 80%, such as at least 85%, preferably at least 90% sequence identity (as defined herein) with IL17MS3084 have a blocking activity, which can be determined by any suitable assay known to the person skilled in the art, such as, for instance, by means of Alphascreen assays (e.g. such as described herein) or by cell based assays (e.g. such as described herein). Preferably, the blocking activity is determined by a HT-1080 cell based assay, for instance, such as described in Example 26. Preferably, said compounds, constructs, proteins or polypeptides that have at least 80%, such as at least 85%, preferably at least 90% sequence identity (as defined herein) with IL17MS3084 have a blocking activity of 1 nM IL-17A-induced IL-6 production in human fibrosarcoma HT-1080 cells with an IC50 of less than 150 nM, more preferably, less than 100 nM, 50 nM or even less, such as less than 20 nM or 15 nM, 10 nM, 9 nM, 8 nM, 7 nM or 6 nM or even more preferably of less than 5 nM, such as 4 nM, 3 nM, 2 nM or even less than 1 nM and/or said compounds, constructs, proteins or polypeptides that have at least 80%, such as at least 85%, preferably at least 90% sequence identity (as defined herein) with IL17MS3084 have a blocking activity of 15 nM IL-17F induced IL-6 production in human fibrosarcoma HT-1080 cells with an IC50 of less than 100 nM, more preferably, less than 75 nM, 50 nM or even less, such as less than 40 nM or 30 nM, 25 nM, 20 nM, 15 nM or even more preferably of less than 10 nM and/or said compounds, constructs, proteins or polypeptides that have at least 80%, such as at least 85%, preferably at least 90% sequence identity (as defined herein) with IL17MS3084 have a blocking activity of 5 nM IL-17A/F-induced IL-6 production in human fibrosarcoma HT-1080 cells with an IC50 of less than 150 nM, more preferably, less than 100 nM, 50 nM or even less, such as less than 20 nM or 15 nM, 10 nM, 9 nM, 8 nM, 7 nM or 6 nM or even more preferably of less than 5 nM, such as 4 nM, or 3 nM, or even less than 2 nM.

Compounds, constructs, proteins or polypeptides that have at least 80%, such as at least 85%, preferably at least 90% sequence identity (as defined herein) with IL17MS3085. Preferably, the compounds, constructs, proteins or polypeptides that have at least 80%, such as at least 85%, preferably at least 90% sequence identity (as defined herein) with IL17MS3085 have a blocking activity, which can be determined by any suitable assay known to the person skilled in the art, such as, for instance, by means of Alphascreen assays (e.g. such as described herein) or by cell based assays (e.g. such as described herein). Preferably, the blocking activity is determined by a HT-1080 cell based assay, for instance, such as described in Example 26. Preferably, said compounds, constructs, proteins or polypeptides that have at least 80%, such as at least 85%, preferably at least 90% sequence identity (as defined herein) with IL17MS3085 have a blocking activity of 1 nM IL-17A-induced IL-6 production in human fibrosarcoma HT-1080 cells with an IC50 of less than 150 nM, more preferably, less than 100 nM, 50 nM or even less, such as less than 20 nM or 15 nM, 10 nM, 9 nM, 8 nM, 7 nM or 6 nM or even more preferably of less than 5 nM, such as 4 nM, 3 nM, 2 nM or even less than 1 nM and/or said compounds, constructs, proteins or polypeptides that have at least 80%, such as at least 85%, preferably at least 90% sequence identity (as defined herein) with IL17MS3085 have a blocking activity of 15 nM IL-17F induced IL-6 production in human fibrosarcoma HT-1080 cells with an IC50 of less than 100 nM, more preferably, less than 75 nM, 50 nM or even less, such as less than 40 nM or 30 nM, 25 nM, 20 nM, 15 nM or even more preferably of less than 10 nM and/or said compounds, constructs, proteins or polypeptides that have at least 80%, such as at least 85%, preferably at least 90% sequence identity (as defined herein) with IL17MS3085 have a blocking activity of 5 nM IL-17A/F-induced IL-6 production in human fibrosarcoma HT-1080 cells with an IC50 of less than 150 nM, more preferably, less than 100 nM, 50 nM or even less, such as less than 20 nM or 15 nM, 10 nM, 9 nM, 8 nM, 7 nM or 6 nM or even more preferably of less than 5 nM, such as 4 nM, or 3 nM, or even less than 2 nM.

Compounds, constructs, proteins or polypeptides that have at least 80%, such as at least 85%, preferably at least 90% sequence identity (as defined herein) with IL17MS3086. Preferably, the compounds, constructs, proteins or polypeptides that have at least 80%, such as at least 85%, preferably at least 90% sequence identity (as defined herein) with IL17MS3086 have a blocking activity, which can be determined by any suitable assay known to the person skilled in the art, such as, for instance, by means of Alphascreen assays (e.g. such as described herein), Kinetic Exclusion Assay "KinExA" technology (e.g. such as described herein) or by cell based assays (e.g. such as described herein). Preferably, the blocking activity is determined by a HT-1080 cell based assay, for instance, such as described in Example 26. Preferably, said compounds, constructs, proteins or polypeptides that have at least 80%, such as at least 85%, preferably at least 90% sequence identity (as defined herein) with IL17MS3086 have a blocking activity of 1 nM IL-17A-induced IL-6 production in human fibrosarcoma HT-1080 cells with an IC50 of less than 150 nM, more preferably, less than 100 nM, 50 nM or even less, such as less than 20 nM or 15 nM, 10 nM, 9 nM, 8 nM, 7 nM or 6 nM or even more preferably of less than 5 nM, such as 4 nM, 3 nM, 2 nM or even less than 1 nM and/or said compounds, constructs, proteins or polypeptides that have at least 80%, such as at least 85%, preferably at least 90% sequence identity (as defined herein) with IL17MS3086 have a blocking activity of 15 nM IL-17F induced IL-6 production in human fibrosarcoma HT-1080 cells with an IC50 of less than 100 nM, more preferably, less than 75 nM, 50 nM or even less, such as less than 40 nM or 30 nM, 25 nM, 20 nM, 15 nM or even more preferably of less than 10 nM and/or said compounds, constructs, proteins or polypeptides that have at least 80%, such as at least 85%, preferably at least 90% sequence identity (as defined herein) with IL17MS3086 have a blocking activity of 5 nM IL-17A/F-induced IL-6 production in human fibrosarcoma HT-1080 cells with an IC50 of less than 150 nM, more preferably, less than 100 nM, 50 nM or even less, such as less than 20 nM or 15 nM, 10 nM, 9 nM, 8 nM, 7 nM or 6 nM or even more preferably of less than 5 nM, such as 4 nM, or even less than 3 nM.

Also preferably, the binding activity is determined by a KinExA technology based assay, for instance, such as described in Example 29. Preferably, said compounds, constructs, proteins or polypeptides that have at least 80%, such as at least 85%, preferably at least 90% sequence identity (as defined herein) with IL17MS3086 (i.e. excluding the tag of IL17MS3091) have a equilibrium dissociation constant (Kd) in solution with hIL-17A of less than 50 pM, more preferably, less than 40 pM, 30 pM or even less, such as less than 20 pM or 15 pM, 10 pM, 9 pM, 8 pM, 7 pM or 6 pM or even more preferably of less than 5 pM, such as 4 pM, 3 pM, 2 pM or even less than 1 pM, such as less than 0.5 pM and/or said compounds, constructs, proteins or polypeptides that have at least 80%, such as at least 85%, preferably at least 90% sequence identity (as defined herein) with IL17MS3086 (i.e. excluding the tag of IL17MS3091) have a equilibrium dissociation constant (Kd) in solution with hIL-17F of less than 100 pM, more preferably, less than 80 pM, 60 pM or even less, such as less than 50 pM, 40 pM, 30 pM, 20 pM or 15 pM, 10 pM, 9 pM, 8 pM, 7 pM or 6 pM or even more preferably of less than 5 pM, such as 4 pM, or 3 pM or even less than 2 pM, such as less than 1.5 pM.

Compounds, constructs, proteins or polypeptides that have at least 80%, such as at least 85%, preferably at least 90% sequence identity (as defined herein) with IL17MS3087. Preferably, the compounds, constructs, proteins or polypeptides that have at least 80%, such as at least 85%, preferably at least 90% sequence identity (as defined herein) with IL17MS3087 have a blocking activity, which can be determined by any suitable assay known to the person skilled in the art, such as, for instance, by means of Alphascreen assays (e.g. such as described herein) or by cell based assays (e.g. such as described herein). Preferably, the blocking activity is determined by a HT-1080 cell based assay, for instance, such as described in Example 26. Preferably, said compounds, constructs, proteins or polypeptides that have at least 80%, such as at least 85%, preferably at least 90% sequence identity (as defined herein) with IL17MS3087 have a blocking activity of 1 nM IL-17A-induced IL-6 production in human fibrosarcoma HT-1080 cells with an IC50 of less than 150 nM, more preferably, less than 100 nM, 50 nM or even less, such as less than 20 nM or 15 nM, 10 nM, 9 nM, 8 nM, 7 nM or 6 nM or even more preferably of less than 5 nM, such as 4 nM, 3 nM, 2 nM or even less than 1 nM and/or said compounds, constructs, proteins or polypeptides that have at least 80%, such as at least 85%, preferably at least 90% sequence identity (as defined herein) with IL17MS3087 have a blocking activity of 15 nM IL-17F induced IL-6 production in human fibrosarcoma HT-1080 cells with an IC50 of less than 100 nM, more preferably, less than 75 nM, 50 nM or even less, such as less than 40 nM or 30 nM, 25 nM, 20 nM, 15 nM or even more preferably of less than 10 nM and/or said compounds, constructs, proteins or polypeptides that have at least 80%, such as at least 85%, preferably at least 90% sequence identity (as defined herein) with IL17MS3087 have a blocking activity of 5 nM IL-17A/F-induced IL-6 production in human fibrosarcoma HT-1080 cells with an IC50 of less than 150 nM, more preferably, less than 100 nM, 50 nM or even less, such as less than 20 nM or 15 nM, 10 nM, 9 nM, 8 nM, 7 nM or 6 nM or even more preferably of less than 5 nM, such as 4 nM, or 3 nM, or even less than 2 nM.

The efficacy of the amino acid sequences and polypeptides of the invention, and of compositions comprising the same, can be tested using any suitable in vitro assay, cell-based assay, in vivo assay and/or animal model known per se, or any combination thereof, depending on the specific disease or disorder involved. Suitable assays and animal models will be clear to the skilled person, and for example include e.g. AlphaScreen, KinExA and Inhibition of IL-17A; -F; -A/F-induced IL-6 production in human fibrosarcoma HT-1080 cells (see experimental part), as well as the assays and animal models used in the experimental part below and in the prior art cited herein.

Also, according to the invention, amino acid sequences and polypeptides that are directed against any of IL-17A, IL-17F and/or IL-17A/F including combinations thereof from a first species of warm-blooded animal may or may not show cross-reactivity with any of IL-17A, IL-17F and/or IL-17A/F including combinations thereof from one or more other species of warm-blooded animal. For example, amino acid sequences and polypeptides directed against human any of IL-17A, IL-17F and/or IL-17A/F including combinations thereof may or may not show cross reactivity with any of IL-17A, IL-17F and/or IL-17A/F including combinations thereof from one or more other species of primates (such as, without limitation, monkeys from the genus *Macaca* (such as, and in particular, cynomolgus monkeys (*Macaca fascicularis*) and/or rhesus monkeys (*Macaca mulatta*) and baboon (*Papio ursinus*)) and/or with any of IL-17A, IL-17F and/or IL-17A/F including combinations thereof from one or more species of animals that are often used in animal models for diseases (for example mouse, rat, rabbit, pig or dog), and in particular in animal models for diseases and disorders associated with any of IL-17A, IL-17F and/or IL-17A/F including combinations thereof (such as the species and animal models mentioned herein). In this respect, it will be clear to the skilled person that such cross-reactivity, when present, may have advantages from a drug development point of view, since it allows the amino acid sequences and polypeptides against any of human IL-17A, IL-17F and/or IL-17A/F including combinations thereof to be tested in such disease models.

More generally, amino acid sequences and polypeptides of the invention that are cross-reactive with any of IL-17A, IL-17F and/or IL-17A/F including combinations thereof from multiple species of mammal will usually be advantageous for use in veterinary applications, since it will allow the same amino acid sequence or polypeptide to be used across multiple species. Thus, it is also encompassed within the scope of the invention that amino acid sequences and polypeptides directed against any of IL-17A, IL-17F and/or IL-17A/F including combinations thereof from one species of animal (such as amino acid sequences and polypeptides against any of human IL-17A, IL-17F and/or IL-17A/F including combinations thereof) can be used in the treatment of another species of animal, as long as the use of the amino acid sequences and/or polypeptides provide the desired effects in the species to be treated.

The present invention is in its broadest sense also not particularly limited to or defined by a specific antigenic determinant, epitope, part, domain, subunit or confirmation (where applicable) of any of IL-17A, IL-17F and/or IL-17A/F including combinations thereof against which the amino acid sequences and polypeptides of the invention are directed. For example, the amino acid sequences and polypeptides may or may not be directed against an "interaction site" (as defined herein). However, it is generally assumed and preferred that the amino acid sequences and polypeptides of the invention are preferably directed against an interaction site (as defined herein), and in particular against an epitope or similar epitopes on any of IL-17A, IL-17F and/or IL-17A/F that allows blocking of a biological response by a single or bi-specific binding unit (see also the different Classes of identified binding molecules of the invention in the experimental part (e.g. Table 1). Thus, in one preferred, but non-limiting aspect, the amino acid sequences and polypeptides of the invention are directed against an epitope that allows binding and/or blocking a biological response to IL-17A, IL-17F and IL-17A/F, and are as further defined herein. In preferred aspect, a polypeptide of the invention may contain two or more amino acid sequences of the invention (and preferably ISV's), wherein at least one amino acid sequence of the invention (preferably an ISV) is directed against or binds to the amino acid(s) L74, Y85 and/or N88 of hIL-17A (SEQ ID NO: 839), and/or wherein at least one amino acid sequence of the invention (preferably an ISV) is directed against or binds to the amino acid(s) R47, R73, I86 and/or N89 of hIL-17F (SEQ ID NO: 840), including combinations thereof.

Accordingly, the present invention relates to an amino acid sequence according to the invention, wherein the amino acid sequence is directed against and/or that can specifically bind to human IL-17 A and IL-17A/F (Class 2), wherein the amino acid sequence binds to a L74A, a Y85A and/or a H54A IL-17A mutant with significantly reduced affinity as compared to binding to the wildtype IL-17A sequence.

Accordingly, the present invention relates to an amino acid sequence according to the invention, wherein said amino acid sequence is directed against and/or that can specifically bind to human IL-17A, IL-17F and IL-17A/F (Class 4), wherein the amino acid sequence binds to a L74A, a Y85A and/or a N88A IL-17A mutant with significantly reduced affinity as compared to binding to the wildtype IL-17A sequence.

Accordingly, the present invention relates to an amino acid sequence according to the invention, wherein said amino acid sequence is directed against and/or that can specifically bind to human IL17F and wherein the amino acid sequence binds to a R47A or R73A or I86A or N89A IL-17F mutant with significantly reduced affinity as compared to binding to the wildtype IL-17F sequence.

In this regard, as used herein "significantly reduced affinity" means an affinity which is lower than the reference affinity. Preferably "significantly reduced affinity" means that the affinity is lower by a factor of at least 1.1, 1.2, 1.3, 1.4, 1.5, 2, 3, 5, 10, 20, 30, 40, 50 or by a factor of at least 100 compared to the reference affinity as indicated.

As further described herein, a polypeptide of the invention may contain two or more amino acid sequences of the invention (and preferably ISV's) that are directed against any of IL-17A, IL-17F and/or IL-17A/F including combinations thereof. Generally, such polypeptides will bind to any of IL-17A, IL-17F and/or IL-17A/F including combinations thereof with increased avidity compared to a single amino acid sequence of the invention (for instance, as determined by KinExA technology as described in Example 22). Such a polypeptide may, for example, comprise two amino acid sequences of the invention that are directed against the same antigenic determinant, epitope, part, domain, subunit or confirmation (where applicable) of any of IL-17A, IL-17F and/or IL-17A/F including combinations thereof (which may or may not be an interaction site); or comprise at least one "first" amino acid sequence of the invention that is directed against a first same antigenic determinant, epitope, part, domain, subunit or confirmation (where applicable) of any of IL-17A, IL-17F and/or IL-17A/F including combinations thereof (which may or may not be an interaction site); and at least one "second"

amino acid sequence of the invention that is directed against a second antigenic determinant, epitope, part, domain, subunit or confirmation (where applicable) different from the first (and which again may or may not be an interaction site). Preferably, in such "biparatopic" polypeptides of the invention, at least one amino acid sequence of the invention is directed against an interaction site (as defined herein), although the invention in its broadest sense is not limited thereto.

Also, when the target is part of a binding pair (i.e. as herein described a receptor-ligand binding pair), the amino acid sequences and polypeptides may be such that they compete with the cognate binding partner (e.g. the ligand, receptor or other binding partner, as applicable) for binding to the target, and/or such that they (fully or partially) neutralize binding of the binding partner to the target.

It is also within the scope of the invention that, where applicable, an amino acid sequence of the invention can bind to two or more antigenic determinants, epitopes, parts, domains, subunits or confirmations of any of IL-17A, IL-17F and/or IL-17A/F including combinations thereof. In such a case, the antigenic determinants, epitopes, parts, domains or subunits of any of IL-17A, IL-17F and/or IL-17A/F including combinations thereof to which the amino acid sequences and/or polypeptides of the invention bind may be essentially the same (for example, if any of IL-17A, IL-17F and/or IL-17A/F including combinations thereof contains repeated structural motifs or occurs in a multimeric form) or may be different (and in the latter case, the amino acid sequences and polypeptides of the invention may bind to such different antigenic determinants, epitopes, parts, domains, subunits of any of IL-17A, IL-17F and/or IL-17A/F including combinations thereof with an affinity and/or specificity which may be the same or different).

It is also expected that the amino acid sequences and polypeptides of the invention will generally bind to all naturally occurring or synthetic analogs, variants, mutants, alleles, parts and fragments of any of IL-17A, IL-17F and/or IL-17A/F including combinations thereof; or at least to those analogs, variants, mutants, alleles, parts and fragments of any of IL-17A, IL-17F and/or IL-17A/F including combinations thereof that contain one or more antigenic determinants or epitopes that are essentially the same as the antigenic determinant(s) or epitope(s) to which the amino acid sequences and polypeptides of the invention bind in any of IL-17A, IL-17F and/or IL-17A/F including combinations thereof (e.g. in wild-type any of IL-17A, IL-17F and/or IL-17A/F including combinations thereof). Again, in such a case, the amino acid sequences and polypeptides of the invention may bind to such analogs, variants, mutants, alleles, parts and fragments with an affinity and/or specificity that are the same as, or that are different from (i.e. higher than or lower than), the affinity and specificity with which the amino acid sequences of the invention bind to (wild-type) any of IL-17A, IL-17F and/or IL-17A/F including combinations thereof. It is also included within the scope of the invention that the amino acid sequences and polypeptides of the invention bind to some analogs, variants, mutants, alleles, parts and fragments of any of IL-17A, IL-17F and/or IL-17A/F including combinations thereof, but not to others.

Also, as will be clear to the skilled person, proteins or polypeptides that contain two or more amino acid sequences (and preferably ISV's) directed against any of IL-17A, IL-17F and/or IL-17A/F including combinations thereof may bind with higher avidity to any of IL-17A, IL-17F and/or IL-17A/F including combinations thereof than the corresponding monomeric amino acid sequence(s). For example, and without limitation, proteins or polypeptides that contain two or more amino acid sequences directed against different epitopes of any of IL-17A, IL-17F and/or IL-17A/F including combinations thereof may (and usually will) bind with higher avidity than each of the different monomers, and proteins or polypeptides that contain two or more amino acid sequences directed against any of IL-17A, IL-17F and/or IL-17A/F including combinations thereof may (and usually will) bind also with higher avidity to a multimer of any of IL-17A, IL-17F and/or IL-17A/F including combinations thereof.

Generally, amino acid sequences and polypeptides of the invention will at least bind to those forms of any of IL-17A, IL-17F and/or IL-17A/F including combinations thereof (including monomeric, multimeric and associated forms) that are the most relevant from a biological and/or therapeutic point of view, as will be clear to the skilled person.

It is also within the scope of the invention to use parts, fragments, analogs, mutants, variants, alleles and/or derivatives of the amino acid sequences and polypeptides of the invention, and/or to use proteins or polypeptides comprising or essentially consisting of one or more of such parts, fragments, analogs, mutants, variants, alleles and/or derivatives, as long as these are suitable for the uses envisaged herein. Such parts, fragments, analogs, mutants, variants, alleles and/or derivatives will usually contain (at least part of) a functional antigen-binding site for binding against any of IL-17A, IL-17F and/or IL-17A/F including combinations thereof; and more preferably will be capable of specific binding to any of IL-17A, IL-17F and/or IL-17A/F including combinations thereof, and even more preferably capable of binding to any of IL-17A, IL-17F and/or IL-17A/F including combinations thereof with an affinity (suitably measured and/or expressed as a $K_D$-value (actual or apparent), a $K_A$-value (actual or apparent), a $k_{on}$-rate and/or a $k_{off}$-rate, or alternatively as an IC50 value, as further described herein) that is as defined herein. Some non-limiting examples of such parts, fragments, analogs, mutants, variants, alleles, derivatives, proteins and/or polypeptides will become clear from the further description herein. Additional fragments or polypeptides of the invention may also be provided by suitably combining (i.e. by linking or genetic fusion) one or more (smaller) parts or fragments as described herein. When the amino acid sequence of the invention is an ISV, such a part, fragment, analog, mutant, variant, allele and/or derivative may be a part, fragment, analog, mutant, variant, allele and/or derivative of such an ISV.

In one specific, but non-limiting aspect of the invention, which will be further described herein, such analogs, mutants, variants, alleles, derivatives have an increased half-life in serum (as further described herein) compared to the amino acid sequence from which they have been derived. For example, an amino acid sequence of the invention may be linked (chemically or otherwise) to one or more groups or moieties that extend the half-life (such as PEG), so as to provide a derivative of an amino acid sequence of the invention with increased half-life.

In one specific, but non-limiting aspect, the amino acid sequence of the invention may be an amino acid sequence that comprises an immunoglobulin fold or may be an amino acid sequence that, under suitable conditions (such as physiological conditions) is capable of forming an immunoglobulin fold (i.e. by folding). Reference is inter alia made to the review by Halaby et al., J. (1999) Protein Eng. 12, 563-71. Preferably, when properly folded so as to form an immunoglobulin fold, such an amino acid sequence is capable of specific binding (as defined herein) to any of IL-17A, IL-17F and/or IL-17A/F including combinations thereof; and more preferably capable of binding to any of IL-17A, IL-17F and/or IL-17A/F including combinations thereof with an affinity (suitably measured and/or expressed as a $K_D$-value (actual or apparent), a $K_A$-value (actual or apparent), a $k_{on}$-rate and/or a $k_{off}$-rate, or alternatively as an IC50 value, as further described herein) that is as defined herein. Also, parts, fragments, analogs, mutants, variants, alleles and/or derivatives of such amino acid sequences are preferably such that they comprise an immunoglobulin fold or are capable for forming, under suitable conditions, an immunoglobulin fold.

In particular, but without limitation, the amino acid sequences of the invention may be amino acid sequences that essentially consist of 4 framework regions (FR1 to FR4 respectively) and 3 complementarity determining regions (CDR1 to CDR3 respectively); or any suitable fragment of such an amino acid sequence (which will then usually contain at least some of the amino acid residues that form at least one of the CDR's, as further described herein).

The amino acid sequences of the invention may in particular be an immunoglobulin sequence or a suitable fragment thereof, and more in particular be an immunoglobulin variable domain sequence or a suitable fragment thereof, such as light chain variable domain sequence (e.g. a $V_L$-sequence) or a suitable fragment thereof; or a heavy chain variable domain sequence (e.g. a $V_H$-sequence) or a suitable fragment thereof. When the amino acid sequence of the invention is a heavy chain variable domain sequence, it may be a heavy chain variable domain sequence that is derived from a conventional four-chain antibody (such as, without limitation, a $V_H$ sequence that is derived from a human antibody) or be a so-called $V_{HH}$-sequence (as defined herein) that is derived from a so-called "heavy chain antibody" (as defined herein).

However, it should be noted that the invention is not limited as to the origin of the amino acid sequence (or ISV) of the invention (or of the nucleotide sequence of the invention used to express it), or as to the way that the amino acid sequence or nucleotide sequence of the invention is (or has been) generated or obtained. Thus, the amino acid sequences of the invention may be naturally occurring amino acid sequences (from any suitable species) or synthetic or semi-synthetic amino acid sequences. In a specific but non-limiting aspect of the invention, the amino acid sequence is a naturally occurring immunoglobulin sequence (from any suitable species) or a synthetic or semi-synthetic immunoglobulin sequence, including but not limited to "humanized" (as defined herein) immunoglobulin sequences (such as partially or fully humanized mouse or rabbit immunoglobulin sequences, and in particular partially or fully humanized $V_{HH}$ sequences or Nanobodies), "camelized" (as defined herein) immunoglobulin sequences, as well as immunoglobulin sequences that have been obtained by techniques such as affinity maturation (for example, starting from synthetic, random or naturally occurring immunoglobulin sequences), CDR grafting, veneering, combining fragments derived from different immunoglobulin sequences, PCR assembly using overlapping primers, and similar techniques for engineering immunoglobulin sequences well known to the skilled person; or any suitable combination of any of the foregoing. Reference is for example made to the standard handbooks, as well as to the further description and prior art mentioned herein.

Similarly, the nucleotide sequences of the invention may be naturally occurring nucleotide sequences or synthetic or semi-synthetic sequences, and may for example be sequences that are isolated by PCR from a suitable naturally occurring template (e.g. DNA or RNA isolated from a cell), nucleotide sequences that have been isolated from a library (and in particular, an expression library), nucleotide sequences that have been prepared by introducing mutations into a naturally occurring nucleotide sequence (using any suitable technique known per se, such as mismatch PCR), nucleotide sequence that have been prepared by PCR using overlapping primers, or nucleotide sequences that have been prepared using techniques for DNA synthesis known per se.

As mentioned, the amino acid sequences of the invention are preferably immunoglobulin single variable domains (ISV's), by which is meant an immunoglobulin variable domain that comprises a functional antigen binding (in the sense that it does not require an interaction with another immunoglobulin variable domain—such as a VH-VL interaction—to form a functional antigen binding site).

The amino acid sequence of the invention may in particular be a domain antibody (or an amino acid sequence that is suitable for use as a domain antibody), a single domain antibody (or an amino acid sequence that is suitable for use as a single domain antibody), a "dAb" (or an amino acid sequence that is suitable for use as a dAb) or a Nanobody™ (as defined herein, and including but not limited to a $V_{HH}$ sequence); other single variable domains, or any suitable fragment of any one thereof. For a general description of (single) domain antibodies, reference is also made to the prior art cited above, as well as to EP 0 368 684. For the term "dAb's", reference is for example made to Ward et al. (Nature 1989 Oct. 12; 341 (6242): 544-6), to Holt et al., Trends Biotechnol., 2003, 21(11):484-490; as well as to for example WO 06/030220, WO 06/003388 and other published patent applications of Domantis Ltd. It should also be noted that, although less preferred in the context of the present invention because they are not of mammalian origin, single domain antibodies or single variable domains can be derived from certain species of shark (for example, the so-called "IgNAR domains", see for example WO 05/18629).

In particular, the amino acid sequence of the invention may be a Nanobody® (as defined herein) or a suitable fragment thereof. [Note: Nanobody®, Nanobodies® and Nanoclone® are registered trademarks of Ablynx N.V.] Such Nanobodies directed against any of IL-17A, IL-17F and/or IL-17A/F including combinations thereof will also be referred to herein as "Nanobodies of the invention".

For a general description of Nanobodies, reference is made to the further description below, as well as to the prior art cited herein. In this respect, it should however be noted that this description and the prior art mainly described Nanobodies of the so-called "$V_H3$ class" (i.e. Nanobodies with a high degree of sequence homology to human germline sequences of the $V_H3$ class such as DP-47, DP-51 or DP-29), which Nanobodies form a preferred aspect of this invention. It should however be noted that the invention in its broadest sense generally covers any type of Nanobody directed against any of IL-17A, IL-17F and/or IL-17A/F including combinations thereof, and for example also covers the Nanobodies belonging to the so-called "$V_H4$ class" (i.e. Nanobodies with a high degree of sequence homology to human germline sequences of the $V_H4$ class such as DP-78), as for example described in WO 07/118,670.

Generally, Nanobodies (in particular $V_{HH}$ sequences and partially humanized Nanobodies) can in particular be characterized by the presence of one or more "Hallmark residues" (as described herein) in one or more of the framework sequences (again as further described herein).

Thus, generally, a Nanobody can be defined as an amino acid sequence with the (general) structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which one or more of the Hallmark residues are as further defined herein.

In particular, a Nanobody can be an amino acid sequence with the (general) structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which the framework sequences are as further defined herein.

More in particular, a Nanobody can be an amino acid sequence with the (general) structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:

i) preferably one or more of the amino acid residues at positions 11, 37, 44, 45, 47, 83, 84, 103, 104 and 108 according to the Kabat numbering are chosen from the Hallmark residues mentioned in Table B-2 below;

and in which:

ii) said amino acid sequence has at least 80% amino acid identity with at least one of the amino acid sequences of SEQ ID NOs: 1 to 22, in which for the purposes of determining the degree of amino acid identity, the amino acid residues that form the CDR sequences (indicated with X in the sequences of SEQ ID NOs: 1 to 22) are disregarded.

In these Nanobodies, the CDR sequences are generally as further defined herein. Thus, the invention also relates to such Nanobodies that can bind to (as defined herein) and/or are directed against any of IL-17A, IL-17F and/or IL-17A/F including combinations thereof, to suitable fragments thereof, as well as to polypeptides that comprise or essentially consist of one or more of such Nanobodies and/or suitable fragments.

SEQ ID NOs: 623 to 693 (see Table A-1) give the amino acid sequences of a number of $V_{HH}$ sequences that have been raised against any of IL-17A, IL-17F and/or IL-17A/F including combinations thereof.

TABLE A-1

Preferred VHH sequences or Nanobody sequences (also referred herein as a sequence with a particular name or SEQ ID NO: X, wherein X is a number referring to the relevant amino acid sequence):

| Name Properties | SEQ ID NO: X, wherein X = | Amino acid sequence |
|---|---|---|
| 01D02Anti-IL-17A | 623 | EVQLVESGGGLVQAGGSLRLSCAASGLSFSS YALGWFRQAPGKERDFVAAINWSGDNTHY ADSVKGRFTISRDNAKNTVSLQMNSLKPED TAVYYCAAQLGYESGYSLTYDYDYWGQGT QVTVSS |
| 01G03Anti-IL-17A | 624 | EVQLVESGGGLVQAGGSLRLSCAASERTISN YDMGWFRQAPGKERELIAADISWSALNTNY ADSVKGRFTISRDNAKNMVYLQMNNLKPE DTAVYYCAARRSGYASFDNWGQGTQVTVS S |
| 02E03Anti-IL-17A | 625 | EVQLVESGGGLVQPGGSLRLSCAASGFTFSS YAMSWARQAPGEGLEWVSDINSGGTRTTY ADSVKGRFTISRDNAKNTLYLQMNSLKPED TAVYVCAKLSVFRSQLGGKYYGGDYENRG QGTQVTVSS |
| 03B08Anti-IL-17A | 626 | EVQLVESGGGLVQAGGSLRLSCAASGFTFD DYAIGWFRQAPGKEREGVSCISSSDGSIYYA DSVKGRFTISSDNAKNTVYLQMNSLKPEDT AVYHCARFGRTGWAEECVDYDYWGQGTQ VTVSS |
| 03E05Anti-IL-17A | 627 | EVQLVESGGGLVQAGGSLRLSCAASGVTFD DYSIGWFRQAPGKEREGVSCISSSDGIPYYSD FVKGRFTTSIDNAKNTVYLQMNSLKPEDTA VYYCAAGFGRLCAEFDSWGQGTQVTVSS |
| 01D06Anti-1L-17A and IL-17A/F | 628 | EVQLVESGGGLVQAGGSLRLSCAADGRTFS TYGMTWFRQVPGKEREFVAHIPRSTYSPYY ANSVKGRFTIARDDAKSTVYLQMNSLKPED TAVYYCAVFTGGTYYVPTAYDYWGQGTQV TVSS |
| 02A08Anti-IL-17A and IL-17A/F | 629 | EVQLVESGGGVVQPGGSLRLSCADSERSFSF NAMGWFRQAPGKEREFVAAISATGDDTYY ADSVKGRFAISRDTARNTVYLQMNSLKPED TAVYYCGARVNFDGTVSYTNDYAYWGQGT QVTVSS |

TABLE A-1-continued

Preferred VHH sequences or Nanobody sequences (also referred herein as a sequence with a particular name or SEQ ID NO: X, wherein X is a number referring to the relevant amino acid sequence):

| Name Properties | SEQ ID NO: X, wherein X = | Amino acid sequence |
|---|---|---|
| 02A10Anti-IL-17A and IL-17A/F | 630 | EVQLVESGGGLVQPGGSLRLSCAASGFALG YYAIGWFRQAPGKEREGVSCDSSSDGRTYY GDSVKGRFTISTDSAKNTVYLQMNSLKPED TAVYYCATCTDFEYDYWGQGTQVTVSS |
| 04B09Anti-IL-17A and IL-17A/F | 631 | EVQLVESGGGLVQPGGSLRLSCAASGFTLG YYAIGWFRQAPGKEREGVSCDSSSDGDTYY ANSVKGRFTISTDNGKNTVYLQMNSLKPED TAVYYCATCTDWNYDYWGQGTQVTVSS |
| 03C07Anti-IL-17A and IL-17A/F | 632 | EVQLVESGGGLVQAGGSLRLSCAASGFTFD DYAIGWFRQAPGKEREAVSCFSSSDGSIYYA DSVKGRFTISSDNAKNTVYLQMNSLKPEDT AVYYCAGGGGSYYYTQLNYCYDMDYWGK GTQVTVSS |
| 04A02Anti-IL-17A and IL-17A/F | 633 | EVQLVESGGGLVQPGGSLRLSCAASRNINIIN YMAWYRQAPGNQRELVAAMTSDATTEYA DSVKGRFTISRDIPENTVYLQMNSLKPEDTA VYYCNAKGIWDYLGRRDFGDYWGQGTQV TVSS |
| 04B10Anti-IL-17A and IL-17A/F | 634 | EVQLVESGGGLVQAGGSQSLSCVASGTIVNI NVMGWYRQAPGKQRELVALITSGGGTTYG DSVKGRFTISIDNAKNTVILQMNSLEAEDTA VYYCAAEIGYYSGGTYFSSEAHWGQGTQVT VSS |
| 04G01Anti-IL-17A and IL-17A/F | 635 | EVQLVESGGGLVQAGGSQRLSCTASGTIVNI HVMGWYRQAPGKQRELVALIFSGGSADYA DSVKGRFTISRDNAKNTVYLEMNSLKAEDT AVYYCAAEIGYYSGGTYYSSEAHWGQGTQ VTVSS |
| 04F09Anti-IL-17A and IL-17A/F | 636 | EVQLVESGGGLVQPGGSLRLSCAASGRTFST HAMGWFRQAPGKERDFVAAIRWSDGSSFY ADSVKGRFTISRDNAKNAVYLQSNSLKSED TAVYVCYADVEGPTALHKYWGRGTQVTVS S |
| 09D10Anti-IL-17A and IL-17A/F | 637 | EVQLVESGGGLVQAGGSLSLSCAASGSVFRI DVMRWHRQAPGKQREFLASIASGGTTNYA DSVKGRFTISRDNAKNTVYLQMNSLKPEDT AVYYCGANAESGPYTYWGLGTQVTVSS |
| 09G10Anti-IL-17A and IL-17A/F | 638 | EVQLVESGGGLVQAGGSLRLSCAASDSVFT AKAVGWYRQPPGLQREWVAIITSGGKTNYA DSSVKGRFTVSVDKVKNTVTLQMNSLKPED TAVYYCYAQWMGRDYWGQGTQVTVSS |
| 11A06Anti-IL-17A and IL-17A/F | 639 | EVQLVESGGGLVQPGESLRLSCKASGFSLDY YALGWFRQAPGKEREGISCITSSDASAYYTD SVKGRFTISRDNSKNTVYLQMNSLKTEDTAI YYCAAALLTCSSYYDAYTYWGQGTQVTVS S |
| 06E11Anti-IL-17F | 640 | EVQLVESGGGLVQAGGSLRLSCPVSGRAFS RGRLGWFRQAPGKEREFVAVAHWSGAITSY ADSVKGRFTFSRDNAKNTMNLQMNSLKPE DTAVYYCAADSETSGNWVYWGQGTQVTVS S |
| 07B09Anti-IL-17F | 641 | EVQLVESGGGLVQAGGSLRLSCGASGGTFS SYATGWFRQAPGKEREFVAVLRWSDGHTA YADSVKGRFTISRDGAKNTMYLQMSSLKPE DTAIYYCTTATRPGEWDYWGQGTQVTVSS |
| 24G10Anti-IL-17F | 642 | EVQLVESGGGLVQAGGSLRLSCGAAGGTFS SYATGWFRQAPGKEREFVAVFRWSDSHTA YADSVKGRFTISRDGAKNTLYLQMSSLKPE DTAIYYCTTATRPGEWDYWGQGTQVTVSS |

TABLE A-1-continued

Preferred VHH sequences or Nanobody sequences (also referred herein as a sequence with a particular name or SEQ ID NO: X, wherein X is a number referring to the relevant amino acid sequence):

| Name Properties | SEQ ID NO: X, wherein X = | Amino acid sequence |
|---|---|---|
| 07B11Anti-IL-17F | 643 | EVQLVESGGGLVQAGGSLRLSCVASGRAFS SYVMGWFRQAPGMEREFVALIRWSDGITGY VDSVKGRFTISRDNAKNTVYLQMNSLKPED TAVYYCAAAVRPGDYDYWGQGTQVTVSS |
| 08A08Anti-IL-17F | 644 | EVQLVESGGGLVQAGGSLRLSCAASGRTFR PYRMGWFRRAPGKAREFVTLISWSSGRTSY ADSVKGRFTISRDSAKNAVYLQMDNLKPED TAVYFCAVDLSGDAVYDSWGQGTQVTVSS |
| 08B07Anti-IL-17F | 645 | EVQLVESGGGLVQPGGSLRLSCAASGRDFR VKNVGWIRQAPGKQRELVATITVGGSTNYA DSAKGRFTISRDNAKNTVYLQMSSLKPEDT AVYYCNAVATVTDYTGTYSDGFWGQGTQV TVSS |
| 08H01Anti-IL-17F | 646 | EVQLVESGGGLVQAGGSLRLSCGASGGTFS SYATGWFRQAPGKEREFVAVLRWSDSHTA YADSVEGRFTISRDGAKNTVYLQMSSLKPE DTAIYYCTTGTRPGEWHYWGQGTQVTVSS |
| 12A09Anti-IL-17F | 647 | EVQLVESGGGLVQPGGSLRLSCAASGFTFSS YRMAWVRQAPGKGLEWVSSTSTGGEMTNY ADSVKGRFTISRDNAKNTLHLQMNSLKPED TALYYCAAGTSAGHWSTGGQGTQVTVSS |
| 16A04Anti-IL-17F | 648 | EVQLVESGGGLVQAGGSLRLSCAASGRTFSS YVVGWFRQAPGKEREFIGAISGSGDSIYYAV SEKDRFTISRDNGKNTLYLQMSSLKAEDTA VYYCTADQEFGYLRFGRSEYWGQGTQVTV SS |
| 24B08Anti-IL-17F | 649 | EVQLVESGGGLVQAGGSLRLSCAVSGGTFS TYKMGWFRQAPGKEREIVARISTNGPTAYA EFVKGRFTVSRENTKNTVYLQMNSLNIEDT AVYYCAAGYDSLFAGYDYWGQGTQVTVSS |
| 01A01Cross-reactive: Anti-IL-17A, IL-17F and IL-17A/F | 650 | EVQLVESGGGLVQAGGSLRLSCAASGFTFD DYDIGWFRQAPGKEREGVSCFTSSDGRTFY ADSVKGRFTVSADNAKNTVYLQMNSLEPED TAVYFCAAVNTFDESAYAAFACYDVVRWG QGTQVTVSS |
| 09B09Cross-reactive: Anti-IL-17A, IL-17F and IL-17A/F | 651 | EMQLVESGGGLVQPGGSLRLSCAASGFTFSS YWMYWARQAPGKGLEWISALAPGGDDEY YADSVNGRFTISRDNAENSLYLQMNSLKSE DTAVYYCAKDHNVGYRTGEYDYGGQGTQ VTVSS |
| 09E11Cross-reactive: Anti-IL-17A, IL-17F and IL-17A/F | 652 | EVQLVESGGGLVQPGGSLRLSCAASGFTFSS YWMYWVRQAPGKGLEWISALAPGGDNRY YADSVNGRFTISRDNAENSLYLQMNSLKSE DTAVYYCAKDHNVGYRTGEYDYGGQGTQ VTVSS |
| 10A04Cross-reactive: Anti-IL-17A, IL-17F and IL-17A/F | 653 | EVQLVESGGGLVQPGGSLRLSCAASGFTFSS YWMYWVRQAPGKGLEWISALAPGGGNRY YAESVNGRFTISRDNAKNSLYLQMNSLKSE DTAVYYCAKDHNVGYRTGEYDYGGQGTQ VTVSS |
| 10A05Cross-reactive: Anti-IL-17A, IL-17F and IL-17A/F | 654 | EVQLVESGGGLVQPGGSLRLSCAASGFTFSN YWMYWVRQAPGKGLEWISALAPGGDNRY YADSVNGRFTISRDNAENSLYLQMNSLKSE DTAVYYCAKDHNVGYRTGEYDYGGQGTQ VTVSS |
| 10D11Cross-reactive: Anti-IL-17A, IL-17F and IL-17A/F | 655 | EVQLVESGGGLVQAGGSLRLSCAASGFTFSS YWMYWVRQAPGKGLEWISALAPGGEHRY YADSVNGRFTISRDNAKNSLYLQMNSLKSE DTAVYYCAKDHNVGYRTGEYDYGGQGTQ VTVSS |

TABLE A-1-continued

Preferred VHH sequences or Nanobody sequences (also referred herein as a sequence with a particular name or SEQ ID NO: X, wherein X is a number referring to the relevant amino acid sequence):

| Name Properties | SEQ ID NO: X, wherein X = | Amino acid sequence |
|---|---|---|
| 10F02Cross-reactive: Anti-IL-17A, IL-17F and IL-17A/F | 656 | EVQLVESGGGLVQPGGSLRLSCAASGFTFSSYWMYWVRQAPGKGLEWISALAPGGGNAYYADSVNGRFTISRDNAENLLYLQMNSLKSEDTAVYYCAKDHNVGYRTGEYDYGGQGTQVTVSS |
| 11A02Cross-reactive: Anti-IL-17A, IL-17F and IL-17A/F | 657 | EVQLVESGGGLVQAGGSLRLSCAASGVIFRLNAMGWYRAAPGKQRELVAIIINGGSTNYADSVKGRFTISRDSAKNAVYLQMNSLKPEDTAVYYCYYNIPGDVYWGQGTQVTVSS |
| 11A07Cross-reactive: Anti-IL-17A, IL-17F and IL-17A/F | 658 | EVQLVESGGGLVQAGGSLRLSCAAPGVIFRLNAMGWYRAAPGKQRELVAIIANGGSTNYADSVKGRFTISRDSAKNAVYLQMNSLKPEDTAVYYCYYNIPGDVYWGQGTRVTVSS |
| 11C08Cross-reactive: Anti-IL-17A, IL-17F and IL-17A/F | 659 | EVQLVESGGGLVQAGGSLRLSCAASGVIFRLNAMGWYRAAPGKQRELVAIIVNGGSTNYADSVKGRFTISRDSAKNAVYLQMNSLKPEDTAVYYCYYNIPGDVYWGQGTQVTVSS |
| 11C09Cross-reactive: Anti-IL-17A, IL-17F and IL-17A/F | 660 | EVQLVESGGGLVQAGGSLRLSCAASGVIFRLNAMGWYRAAPGKQRELVAIIVNGGSTNYADSVKGRFTISRDSAKNAVYLQMDSLKPEDTAVYYCYYNIPGDVYWGQGTQVTVSS |
| 12H11Cross-reactive: Anti-IL-17A, IL-17F and IL-17A/F | 661 | EVQLVESGGGLVQPGGSLRLSCAASGVIFRLNAMGWYRAAPGKQRELVAIIVNGGSTNYADSVKGRFTISRDNAKNAVYLQMNSLKPEDTAVYYCYYNIPGDVYWGQGTQVTVSS |
| 13B03Cross-reactive: Anti-IL-17A, IL-17F and IL-17A/F | 662 | EVQLVESGGGSVQAGDSLRLSCAASGRANSINWFGWFRQTPGKEREFVAGIRWSDAYTEYANSVKGRFTISRDNAKNTVDLQMDSLKPEDTAVYYCVLDLSTVRYWGQGTQVTVSS |
| 13D05Cross-reactive: Anti-IL-17A, IL-17F and IL-17A/F | 663 | EVQLVESGGGSVQAGDSLRLSCAASGRANSINWFGWFRQTPGKEREFVAGIRWTDAYTEYAASVKGRFTISRDNAKNTVGLQMDSLKPEDTAVYYCVLDLSTVRYWGQGSQVTVSS |
| 13E02Cross-reactive: Anti-IL-17A, IL-17F and IL-17A/F | 664 | EVQLVESGGGLVQAGGSLRLSCAASGRTYDAMGWLRQAPGKEREFVAAISGSGDDTYYADSVKGRFTISKDNAGITMYLQMNSLKPEDTAVYYCATRRGLYYVWDSNDYENWGQGTQVTVSS |
| 01D08Cross-reactive: Anti-IL-17A, IL-17F and IL-17A/F | 665 | EVQLVESGGGLVQAGGSLRLSCAASGRTYYAMGWLRQAPGKEREFVAAISGSGDDTYYADSVKGRFTISKDNAGITMYLEMNSLKPEDTAVYYCATRRGRYYVWDSNDYENWGQGTQVTVSS |
| 13E07Cross-reactive: Anti-IL-17A, IL-17F and IL-17A/F | 666 | EVQLVESGGGLVQAGGSLRLSCAASGRTYYAMGWLRQAPGKEREFVAAISGSGDDTYYADSVKGRFTISKDNAGITMYLQMNSLKPEDTAVYYCATRRGLYYVWDSNDYENWGQGTQVTVSS |
| 13G06Cross-reactive: Anti-IL-17A, IL-17F and IL-17A/F | 667 | EVQLVESGGGLVQAGGSLRLSCAASGRTYHAMGWLRQAPGKEREFVAAVSGSGDDTYYADSVKGRFTISKDNAGITMYLQMNSLKPEDTAVYYCATRRGLYYVWDSNDYENWGQGTQVTVSS |
| 13H05Cross-reactive: Anti-IL-17A, IL-17F and IL-17A/F | 668 | EVQLVESGGGLVQAGGSLRLSCAASGRTYDAMGWFRQAPGKEREFVAAISGSGEDTYYADSVKGRFTCSKDNAKDTMYLQMNSLKPEDTAVYYCATRRGLYFITDSNDYENWGQGTQVTVSS |

TABLE A-1-continued

Preferred VHH sequences or Nanobody sequences (also referred herein as a sequence with a particular name or SEQ ID NO: X, wherein X is a number referring to the relevant amino acid sequence):

| Name Properties | SEQ ID NO: X, wherein X = | Amino acid sequence |
|---|---|---|
| 13E05Cross-reactive: Anti-IL-17A, IL-17F and IL-17A/F | 669 | EVQLVESGGGKVQAGDSLTLSCVASGGTFS NYAAWFRQAPGKDRRELVVSIFRTGSITYTA DSVKGRFTASRVNTKNTVYLQMNSLKPEDT AVYYCASAYNPGVGYDYWGQGTQVTVSS |
| 17B03Cross-reactive: Anti-IL-17A, IL-17F and IL-17A/F | 670 | EVQLVESGGGLVQAGGSLRLSCEASGGTFS NYAAWFRQGPGKGRELVVSIFRSGTITYTAD SVKGRFTASRVNTKNTVYLQMNSLKPEDTG IYYCASAYNPGIGYDYWGQGTQVTVSS |
| 17D08Cross-reactive: Anti-IL-17A, IL-17F and IL-17A/F | 671 | EVQLVESGGGLVQAGDSLTLSCVASGGTFS NYAAWFRQAPGKDRRELVVSIFRTGSITYTA DSVKGRFTASRVNTKNTVYLQMNSLKPEDT AVYYCASAYNPGVGYDYWGQGTQVTVSS |
| 17E05Cross-reactive: Anti-IL-17A, IL-17F and IL-17A/F | 672 | EVQLVESGGGLVQAGDSLRLSCEASGGTFS NYAAWFRQGPGKGRELVVSIFRSGTITYTAD SVKGRFTASRVNTKNTVYLQMNSLKPEDTG IYYCASAYNPGIGYDYWGQGTQVTVSS |
| 17G08Cross-reactive: Anti-IL-17A, IL-17F and IL-17A/F | 673 | EVQLVESGGGLVQPGGSLRLSCEASGGTFSN YAAWFRQGPGKGRELVVSIFRSGTITYTADS VKGRFTASRVNTKNTVYLQMNSLKPEDTGI YYCASAYNPGIGYDYWGQGTQVTVSS |
| 17H04Cross-reactive: Anti-IL-17A, IL-17F and IL-17A/F | 674 | EVQLVESGGGLVQAGDSLRLSCVASGGTFS NYAAWFRQAPGKGRELILSIFRSGSITYTADS VKGRFTGSRVNTKNTAYLQMNNLKPEDTA VYYCASAYNPGIGYDYWGQGTQVTVSS |
| 17H07Cross-reactive: Anti-IL-17A, IL-17F and IL-17A/F | 675 | EVQLVESGGGLVQAGDSLTLSCVASGGTFS NYAAWFRQAPGKDRRELVVSIFRTGSITYTA DSVKGRFTASRVNTKNTVYLQMNSLKPEDT AVYYCASAYNPGVGYDYWGQGTQVTVSS |
| 01C09Cross-reactive: Anti-IL-17A, IL-17F and IL-17A/F | 676 | EVQLVKSGGGLVQAGGSLKLSCAASGRTFT TYPMGWFRQAPGKEREFVGAISMSGEDTIY ATSVKGRFTISRDDARNTVTLHMTSLKPEDT AVYYCAARTSYNGRYDYIDDYSYWGQGTQ VTVSS |
| 01F10Cross-reactive: Anti-IL-17A, IL-17F and IL-17A/F | 677 | EVQLVESGGGLVQAGGSLRLSCAASGRTFT TYPMGWFRQAPGKEREFVAAISMSGEDAAY ATSVKGRFTISRDNARNTVYLHMTTLKPED TAVYYCAARTSYNGIYDYIDDYSYWGQGT Q VTVSS |
| 02D02Cross-reactive: Anti-IL-17A, IL-17F and IL-17A/F | 678 | EVQLVESGGGLVQAGGSLKLSCARSGRTFT TYPMGWFRQAPGKEREFVAAISMSGDDTAY ATFVKGRFTIVRDDDKNTVYLHMTSLKPED TAVYYCAARTSYSGTYDYIDDYSYWGQGT QVTVSS |
| 13A08Cross-reactive: Anti-IL-17A, IL-17F and IL-17A/F | 679 | EVQLVESRGRLVQAGGSLRLSCAASGRTFTS YPMGWFRQAPGKEREFVAAISMSGDDAAY ADFVRGRFTISRDDARNTVYLHMTSLKPED TAVYYCAARTSYDGTYDYIDDYSYWGQGT QVTVSS |
| 13B05Cross-reactive: Anti-IL-17A, IL-17F and IL-17A/F | 680 | EVQLVESGGRLVQAGGSLRLSCAASGRTFTS YPMGWFRQAPGKEREFVAAISMSGDDTAYT DFVRGRFTISRDDARNTVYLHMTSLKPEDT AVYYCAARTSYDGTYDYIDDYSYWGQGTQ VTVSS |
| 13C06Cross-reactive: Anti-IL-17A, IL-17F and IL-17A/F | 681 | EVQLVESGGRLVQAGGSLRLSCAASGRTFTS YPMGWFRQAPGKEREFVAAISMSGDDAAY ADFVRGRFTISRDDARNTVYLHMTSLKPED TAVYYCAARTSYDGTYDYIDDYSYWGQGT QVTVSS |

TABLE A-1-continued

Preferred VHH sequences or Nanobody sequences (also referred herein as a sequence with a particular name or SEQ ID NO: X, wherein X is a number referring to the relevant amino acid sequence):

| Name | Properties | SEQ ID NO: X, wherein X = | Amino acid sequence |
|---|---|---|---|
| 13E01 | Cross-reactive: Anti-IL-17A, IL-17F and IL-17A/F | 682 | EVQLVESEGGLVQAGGSLRLSCARSGHAFTSYPMGWFRQAPGKEREFVAAISMSGDDTIYRDFVKGRFTISRDNARNTVYLHMTSLKPEDTAVYYCAARTSYDGRYDYIDDYSYWGQGTQVTVSS |
| 13E03 | Cross-reactive: Anti-IL-17A, IL-17F and IL-17A/F | 683 | EVQLVESGGGLVQAGGSLRLSCAASGRTFTTYPMGWFRQAPGKEREFVAAISMSGDDTAYATFVKGRFTISRDSARNTVYLHMTRLKPEDTAVYSCAARTSYDGRYDYIDDYSDWGQGTQVTVSS |
| 13E08 | Cross-reactive: Anti-IL-17A, IL-17F and IL-17A/F | 684 | EVQLVESRGGLVQAGGSLRLSCAGSGRTLYSYPMGWFRQAPGKEREFVAAISMSGDDTAVATFVKGRFTISRDNARNTVYLHMTSLKPEDTAVYHCAARTSYSGRYDYIDDYSYWGQGTQVTVSS |
| 13G04 | Cross-reactive: Anti-IL-17A, IL-17F and IL-17A/F | 685 | EVQLVESGGGLVQAGGSLRLSCAASGRTLYSYPMGWFRQAPGKEREFVAAISMSGDDTAVATFVKGRFTISRDNARNTVYLHMSSLKPEDTAVYHCAARTSYSGRYDYIDDYSYWGQGTQVTVSS |
| 13G05 | Cross-reactive: Anti-IL-17A, IL-17F and IL-17A/F | 686 | EVQLVESGGGLVQAGGSLELSCARSGRTFTTYPMGWFRQAPGKEREFVAAISMSGDDTAYATFVKGRFTFSRDDDKNTVYLHMTSLKPEDTAVYYCAARTSYSGMYDYIHDYSYWGQGTQVTVSS |
| 13G08 | Cross-reactive: Anti-IL-17A, IL-17F and IL-17A/F | 687 | EVQLVESGGGLVQAGGSLRLSCAASGRTFFSYPMGWFRQAPGKEREFVAAISMSGDDSAYRDFVKGRFTISRDNARDTVYLHMTSLKPEDTAIYYCAARTSYNGRYDYIDDYSYWGQGTQVTVSS |
| 13H03 | Cross-reactive: Anti-IL-17A, IL-17F and IL-17A/F | 688 | EVQLVESGGGLVQAGGSLRLSCAASGRTFTTYPMGWFRQAPGKEREFVAAISMSGDDTAYATFVKGRFTISRDNARNTVYLHMTRLKPEDTAVYSCAARTSYDGRYDYIDDYSDWGQGTQVTVSS |
| 17C01 | Cross-reactive: Anti-IL-17A, IL-17F and IL-17A/F | 689 | EVQLVESGGRLVQAGGSLRLPCAASGRTFTSYPMGWFRQAPGKEREFVAAISMSGDDAAYADFVRGRFTISRDDARNTVYLHMTSLKPEDTAVYYCAARTSYDGTYDYIDDYSYWGQGTQVTVSS |
| 15A08 | Cross-reactive: Anti-IL-17A, IL-17F and IL-17A/F | 690 | EVQLVESGGGLVQPGGSLRLSCAASGFTLDYYAIGWFRQAPGKEREGVSCVSSSDGRTAYADSVKGRFTISRDNAKNTVYLQMNSLKPEDTAVYYCATVMEYGLGCTTDVLDAWGQGTLVTVSS |
| 13G02 | Cross-reactive: Anti-IL-17A, IL-17F and IL-17A/F | 691 | EVQLVESRGGLVQAGGSLRLSCAASGGTFSVFAMRWFRQAPGKEREFVAGISWTGGTTYYADSVKGRFTMSADNAKNTVYLQMNSLKPEDTAVYYCAVDVGGGSDRYLGQGTQVTVSS |
| 17E02 | Cross-reactive: Anti-IL-17A, IL-17F and IL-17A/F | 692 | EVQLVESRGGLVQAGGSLRLSCAASGGTFSVFAMRWFRQAPGKEREFVAGISWTGGTTYYADSVKGRFTMSADNAKNTVYLQMNSLKPEDTAVYYCAVDVGGGSDRYLGQGTQVTVSS |
| 18B05 | Cross-reactive: Anti-IL-17A, IL-17F and IL-117A/F | 693 | EVQLVKSGGGLVQPGGSLRLSCAASGGTFSLFAMGWFREAPGKEREFVAAIRWSDGSSYYADSVKGRFTISRDNAKNAVHLQSNSLKSEDTAVYYCYADVQGGLHRYWGQGTQVTVSS |

In particular, the invention in some specific aspects provides:

amino acid sequences (and in particular, ISV's) that are directed against (as defined herein) any of IL-17A, IL-17F and/or IL-17A/F including combinations thereof and that have at least 80%, preferably at least 85%, such as 90% or 95% or more sequence identity with at least one of the amino acid sequences of SEQ ID NOs: 623 to 693 (see Table A-1). These amino acid sequences may further be such that they neutralize binding of the cognate ligand to any of IL-17A, IL-17F and/or IL-17A/F including combinations thereof; and/or compete with the cognate ligand for binding to any of IL-17A, IL-17F and/or IL-17A/F including combinations thereof; and/or are directed against an interaction site (as defined herein) on any of IL-17A, IL-17F and/or IL-17A/F including combinations thereof (such as the ligand binding site);

amino acid sequences (and in particular, ISV's) that cross-block (as defined herein) the binding of at least one of the amino acid sequences of SEQ ID NOs: 623 to 693 (see Table A-1) to any of IL-17A, IL-17F and/or IL-17A/F including combinations thereof and/or that compete with at least one of the amino acid sequences of SEQ ID NOs: 623 to 693 (see Table A-1) for binding to any of IL-17A, IL-17F and/or IL-17A/F including combinations thereof. Again, these amino acid sequences may further be such that they neutralize binding of the cognate ligand to any of IL-17A, IL-17F and/or IL-17A/F including combinations thereof; and/or compete with the cognate ligand for binding to any of IL-17A, IL-17F and/or IL-17A/F including combinations thereof; and/or are directed against an interaction site (as defined herein) on any of IL-17A, IL-17F and/or IL-17A/F including combinations thereof (such as the ligand binding site);

which amino acid sequences (or ISV's) may be as further described herein (and may for example be Nanobodies); as well as polypeptides of the invention that comprise one or more of such amino acid sequences (which may be as further described herein, and may for example be bispecific and/or biparatopic polypeptides as described herein), and nucleic acid sequences that encode such amino acid sequences and polypeptides. Such amino acid sequences and polypeptides do not include any naturally occurring ligands.

In some other specific aspects, the invention provides:

amino acid sequences (and in particular, ISV's) of the invention that are specific for any of IL-17A, IL-17F and/or IL-17A/F including combinations thereof compared to IL-17B, IL-17C, IL-17D, and/or IL-17E;

which amino acid sequences of the invention may be as further described herein (and may for example be Nanobodies); as well as polypeptides of the invention that comprise one or more of such amino acid sequences (which may be as further described herein, and may for example be bispecific and/or biparatopic polypeptides as described herein), and nucleic acid sequences that encode such amino acid sequences and polypeptides. Such amino acid sequences and polypeptides do not include any naturally occurring ligands.

Accordingly, some particularly preferred Nanobodies of the invention are Nanobodies which can bind (as further defined herein) to and/or are directed against to any of IL-17A, IL-17F and/or IL-17A/F including combinations thereof and which:

i) have at least 80% amino acid identity with at least one of the amino acid sequences of SEQ ID NOs: 623 to 693 (see Table A-1), in which for the purposes of determining the degree of amino acid identity, the amino acid residues that form the CDR sequences are disregarded. In this respect, reference is also made to Table B-1, which lists the framework 1 sequences (SEQ ID NOs: 126 to 196), framework 2 sequences (SEQ ID NOs: 268 to 338) framework 3 sequences (SEQ ID NOs: 410 to 480) and framework 4 sequences (SEQ ID NOs: 552 to 622) of the Nanobodies of SEQ ID NOs: 623 to 693 (see Table A-1) (with respect to the amino acid residues at positions 1 to 4 and 27 to 30 of the framework 1 sequences, reference is also made to the comments made below. Thus, for determining the degree of amino acid identity, these residues are preferably disregarded);

and in which:

ii) preferably one or more of the amino acid residues at positions 11, 37, 44, 45, 47, 83, 84, 103, 104 and 108 according to the Kabat numbering are chosen from the Hallmark residues mentioned in Table B-2 below.

In these Nanobodies, the CDR sequences are generally as further defined herein.

Again, such Nanobodies may be derived in any suitable manner and from any suitable source, and may for example be naturally occurring $V_{HH}$ sequences (i.e. from a suitable species of Camelid) or synthetic or semi-synthetic amino acid sequences, including but not limited to "humanized" (as defined herein) Nanobodies, "camelized" (as defined herein) immunoglobulin sequences (and in particular camelized heavy chain variable domain sequences), as well as Nanobodies that have been obtained by techniques such as affinity maturation (for example, starting from synthetic, random or naturally occurring immunoglobulin sequences), CDR grafting, veneering, combining fragments derived from different immunoglobulin sequences, PCR assembly using overlapping primers, and similar techniques for engineering immunoglobulin sequences well known to the skilled person; or any suitable combination of any of the foregoing as further described herein. Also, when a Nanobody comprises a $V_{HH}$ sequence, said Nanobody may be suitably humanized, as further described herein, so as to provide one or more further (partially or fully) humanized Nanobodies of the invention. Similarly, when a Nanobody comprises a synthetic or semi-synthetic sequence (such as a partially humanized sequence), said Nanobody may optionally be further suitably humanized, again as described herein, again so as to provide one or more further (partially or fully) humanized Nanobodies of the invention.

In particular, humanized Nanobodies may be amino acid sequences that are as generally defined for Nanobodies in the previous paragraphs, but in which at least one amino acid residue is present (and in particular, in at least one of the framework residues) that is and/or that corresponds to a humanizing substitution (as defined herein). Some preferred, but non-limiting humanizing substitutions (and suitable combinations thereof) will become clear to the skilled person based on the disclosure herein. In addition, or alternatively, other potentially useful humanizing substitutions can be ascertained by comparing the sequence of the framework regions of a naturally occurring $V_{HH}$ sequence with the corresponding framework sequence of one or more closely related human $V_H$ sequences, after which one or more of the potentially useful humanizing substitutions (or combinations thereof) thus determined can be introduced into said $V_{HH}$ sequence (in any manner known per se, as further described herein) and the resulting humanized $V_{HH}$ sequences can be tested for affinity for the target, for stability, for ease and level of expression, and/or for other desired properties. In this way, by means of a limited degree of trial and error, other suitable humanizing substitutions (or suitable combinations thereof) can be determined by the skilled person based on the disclosure herein. Also, based on the foregoing, (the framework regions of) a Nanobody may be partially humanized or fully humanized.

Thus, some other preferred Nanobodies of the invention are Nanobodies which can bind (as further defined herein) to any of IL-17A, IL-17F and/or IL-17A/F including combinations thereof and which:

i) are a humanized variant of one of the amino acid sequences of SEQ ID NOs: 623 to 693 (see Table A-1); and/or ii) have at least 80% amino acid identity with at least one of the amino acid sequences of SEQ ID NOs: 623 to 693 (see Table A-1), in which for the purposes of determining the degree of amino acid identity, the amino acid residues that form the CDR sequences are disregarded;

and in which:

i) preferably one or more of the amino acid residues at positions 11, 37, 44, 45, 47, 83, 84, 103, 104 and 108 according to the Kabat numbering are chosen from the Hallmark residues mentioned in Table B-2 below.

According to another specific aspect of the invention, the invention provides a number of stretches of amino acid residues (i.e. small peptides) that are particularly suited for binding to any of IL-17A, IL-17F and/or IL-17A/F including combinations thereof. These stretches of amino acid residues may be present in, and/or may be incorporated into, an amino acid sequence of the invention, in particular in such a way that they form (part of) the antigen binding site of an amino acid sequence of the invention. As these stretches of amino acid residues were first generated as CDR sequences of heavy chain antibodies or $V_{HH}$ sequences that were raised against any of IL-17A, IL-17F and/or IL-17A/F including combinations thereof (or may be based on and/or derived from such CDR sequences, as further described herein), they will also generally be referred to herein as "CDR sequences" (i.e. as CDR1 sequences, CDR2 sequences and CDR3 sequences, respectively). It should however be noted that the invention in its broadest sense is not limited to a specific structural role or function that these stretches of amino acid residues may have in an amino acid sequence of the invention, as long as these stretches of amino acid residues allow the amino acid sequence of the invention to bind to any of IL-17A, IL-17F and/or IL-17A/F including combinations thereof. Thus, generally, the invention in its broadest sense comprises any amino acid sequence that is capable of binding to any of IL-17A, IL-17F and/or IL-17A/F including combinations thereof and that comprises one or more CDR sequences as described herein, and in particular a suitable combination of two or more such CDR sequences, that are suitably linked to each other via one or more further amino acid sequences, such that the entire amino acid sequence forms a binding domain and/or binding unit that is capable of binding to any of IL-17A, IL-17F and/or IL-17A/F including combinations thereof. It should however also be noted that the presence of only one of such CDR sequence in an amino acid sequence of the invention may by itself already be sufficient to provide an amino acid sequence of the invention that is capable of binding to any of IL-17A, IL-17F and/or IL-17A/F including combinations thereof; reference is for example again made to the so-called "Expedite fragments" described in WO 03/050531 or subsequent filings.

Thus, in another specific, but non-limiting aspect, the amino acid sequence (or ISV) of the invention may be an amino acid sequence that comprises at least one amino acid sequence that is chosen from the group consisting of the CDR1 sequences, CDR2 sequences and CDR3 sequences that are described herein (or any suitable combination thereof). In particular, an amino acid sequence of the invention may be an amino acid sequence that comprises at least one antigen binding site, wherein said antigen binding site comprises at least one amino acid sequence that is chosen from the group consisting of the CDR1 sequences, CDR2 sequences and CDR3 sequences that are described herein (or any suitable combination thereof).

Generally, in this aspect of the invention, the amino acid sequence (or ISV) of the invention may be any amino acid sequence that comprises at least one stretch of amino acid residues, in which said stretch of amino acid residues has an amino acid sequence that corresponds to the sequence of at least one of the CDR sequences described herein. Such an amino acid sequence may or may not comprise an immunoglobulin fold. For example, and without limitation, such an amino acid sequence may be a suitable fragment of an immunoglobulin sequence that comprises at least one such CDR sequence, but that is not large enough to form a (complete) immunoglobulin fold (reference is for example again made to the "Expedite fragments" described in WO 03/050531). Alternatively, such an amino acid sequence may be a suitable "protein scaffold" that comprises least one stretch of amino acid residues that corresponds to such a CDR sequence (i.e. as part of its antigen binding site). Suitable scaffolds for presenting amino acid sequences will be clear to the skilled person, and for example comprise, without limitation, to binding scaffolds based on or derived from immunoglobulins (i.e. other than the immunoglobulin sequences already described herein), protein scaffolds derived from protein A domains (such as Affibodies™), tendamistat, fibronectin, lipocalin, CTLA-4, T-cell receptors, designed ankyrin repeats, avimers and PDZ domains (Binz et al., Nat. Biotech 2005, 23:1257), and binding moieties based on DNA or RNA including but not limited to DNA or RNA aptamers (Ulrich et al., Comb Chem High Throughput Screen 2006 9(8):619-32).

Again, any amino acid sequence (or ISV) of the invention that comprises one or more of these CDR sequences is preferably such that it can specifically bind (as defined herein) to any of IL-17A, IL-17F and/or IL-17A/F including combinations thereof, and more in particular such that it can bind to any of IL-17A, IL-17F and/or IL-17A/F including combinations thereof with an affinity (suitably measured and/or expressed as a $K_D$-value (actual or apparent), a $K_A$-value (actual or apparent), $k_{on}$-rate and/or a $k_{off}$-rate, or alternatively as an IC50 value, as further described herein), that is as defined herein.

More in particular, the amino acid sequences according to this aspect of the invention may be any amino acid sequence (or ISV) that comprises at least one antigen binding site, wherein said antigen binding site comprises at least two amino acid sequences that are chosen from the group consisting of the CDR1 sequences described herein, the CDR2 sequences described herein and the CDR3 sequences described herein, such that (i) when the first amino acid sequence is chosen from the CDR1 sequences described herein, the second amino acid sequence is chosen from the CDR2 sequences described herein or the CDR3 sequences described herein; (ii) when the first amino acid sequence is chosen from the CDR2 sequences described herein, the second amino acid sequence is chosen from the CDR1 sequences described herein or the CDR3 sequences described herein; or (iii) when the first amino acid sequence is chosen from the CDR3 sequences described herein, the second amino acid sequence is chosen from the CDR1 sequences described herein or the CDR3 sequences described herein.

Even more in particular, the amino acid sequences of the invention may be amino acid sequences (or ISV's) that comprise at least one antigen binding site, wherein said antigen binding site comprises at least three amino acid sequences that are chosen from the group consisting of the CDR1 sequences described herein, the CDR2 sequences described herein and the CDR3 sequences described herein, such that the first amino acid sequence is chosen from the CDR1 sequences described herein, the second amino acid sequence is chosen from the CDR2 sequences described herein, and the third amino acid sequence is chosen from the CDR3 sequences described herein. Preferred combinations of CDR1, CDR2 and CDR3 sequences will become clear from the further description herein. As will be clear to the skilled person, such an amino acid sequence is preferably an immunoglobulin sequence (as further described herein), but it may for example also be any other amino acid sequence that comprises a suitable scaffold for presenting said CDR sequences.

Thus, in one specific, but non-limiting aspect, the invention relates to an amino acid sequence (and in particular, an ISV) directed against any of IL-17A, IL-17F and/or IL-17A/F including combinations thereof, that comprises one or more stretches of amino acid residues chosen from the group consisting of:

a) the amino acid sequences of SEQ ID NOs: 197 to 267;
b) amino acid sequences that have at least 80% amino acid identity with at least one of the amino acid sequences of SEQ ID NOs: 197 to 267;
c) amino acid sequences that have 3, 2, or 1 amino acid difference with at least one of the amino acid sequences of SEQ ID NOs: 197 to 267;
d) the amino acid sequences of SEQ ID NOs: 339 to 409;
e) amino acid sequences that have at least 80% amino acid identity with at least one of the amino acid sequences of SEQ ID NOs: 339 to 409;
f) amino acid sequences that have 3, 2, or 1 amino acid difference with at least one of the amino acid sequences of SEQ ID NOs: 339 to 409;
g) the amino acid sequences of SEQ ID NOs: 481 to 551;
h) amino acid sequences that have at least 80% amino acid identity with at least one of the amino acid sequences of SEQ ID NOs: 481 to 551;
i) amino acid sequences that have 3, 2, or 1 amino acid difference with at least one of the amino acid sequences of SEQ ID NOs: 481 to 551;

or any suitable combination thereof.

When an amino acid sequence (or ISV) of the invention contains one or more amino acid sequences according to b) and/or c):

i) any amino acid substitution in such an amino acid sequence according to b) and/or c) is preferably, and compared to the corresponding amino acid sequence according to a), a conservative amino acid substitution, (as defined herein);

and/or ii) the amino acid sequence according to b) and/or c) preferably only contains amino acid substitutions, and no amino acid deletions or insertions, compared to the corresponding amino acid sequence according to a);

and/or iii) the amino acid sequence according to b) and/or c) may be an amino acid sequence that is derived from an amino acid sequence according to a) by means of affinity maturation using one or more techniques of affinity maturation known per se.

Similarly, when an amino acid sequence of the invention contains one or more amino acid sequences according to e) and/or f):

i) any amino acid substitution in such an amino acid sequence according to e) and/or f) is preferably, and compared to the corresponding amino acid sequence according to d), a conservative amino acid substitution, (as defined herein);

and/or ii) the amino acid sequence according to e) and/or f) preferably only contains amino acid substitutions, and no amino acid deletions or insertions, compared to the corresponding amino acid sequence according to d);

and/or iii) the amino acid sequence according to e) and/or f) may be an amino acid sequence that is derived from an amino acid sequence according to d) by means of affinity maturation using one or more techniques of affinity maturation known per se.

Also, similarly, when an amino acid sequence of the invention contains one or more amino acid sequences according to h) and/or i):

i) any amino acid substitution in such an amino acid sequence according to h) and/or i) is preferably, and compared to the corresponding amino acid sequence according to g), a conservative amino acid substitution, (as defined herein);

and/or ii) the amino acid sequence according to h) and/or i) preferably only contains amino acid substitutions, and no amino acid deletions or insertions, compared to the corresponding amino acid sequence according to g);

and/or iii) the amino acid sequence according to h) and/or i) may be an amino acid sequence that is derived from an amino acid sequence according to g) by means of affinity maturation using one or more techniques of affinity maturation known per se.

It should be understood that the last preceding paragraphs also generally apply to any amino acid sequences of the invention that comprise one or more amino acid sequences according to b), c), e), f), h) i), respectively.

In this specific aspect, the amino acid sequence (or ISV) preferably comprises one or more stretches of amino acid residues chosen from the group consisting of i) the amino acid sequences of SEQ ID NOs: 197 to 267;
ii) the amino acid sequences of SEQ ID NOs: 339 to 409; and
iii) the amino acid sequences of SEQ ID NOs: 481 to 551;

or any suitable combination thereof.

Also, preferably, in such an amino acid sequence, at least one of said stretches of amino acid residues forms part of the antigen binding site for binding against any of IL-17A, IL-17F and/or IL-17A/F, including combinations thereof.

In a more specific, but again non-limiting aspect, the invention relates to an amino acid sequence (or ISV) directed against any of IL-17A, IL-17F and/or IL-17A/F including combinations thereof, that comprises two or more stretches of amino acid residues chosen from the group consisting of:

a) the amino acid sequences of SEQ ID NOs: 197 to 267;
b) amino acid sequences that have at least 80% amino acid identity with at least one of the amino acid sequences of SEQ ID NOs: 197 to 267;

c) amino acid sequences that have 3, 2, or 1 amino acid difference with at least one of the amino acid sequences of SEQ ID NOs: 197 to 267;
d) the amino acid sequences of SEQ ID NOs: 339 to 409;
e) amino acid sequences that have at least 80% amino acid identity with at least one of the amino acid sequences of SEQ ID NOs: 339 to 409;
f) amino acid sequences that have 3, 2, or 1 amino acid difference with at least one of the amino acid sequences of SEQ ID NOs: 339 to 409;
g) the amino acid sequences of SEQ ID NOs: 481 to 551;
h) amino acid sequences that have at least 80% amino acid identity with at least one of the amino acid sequences of SEQ ID NOs: 481 to 551;
i) amino acid sequences that have 3, 2, or 1 amino acid difference with at least one of the amino acid sequences of SEQ ID NOs: 481 to 551;

such that (i) when the first stretch of amino acid residues corresponds to one of the amino acid sequences according to a), b) or c), the second stretch of amino acid residues corresponds to one of the amino acid sequences according to d), e), f), g), h) or i); (ii) when the first stretch of amino acid residues corresponds to one of the amino acid sequences according to d), e) or f), the second stretch of amino acid residues corresponds to one of the amino acid sequences according to a), b), c), g), h) or i); or (iii) when the first stretch of amino acid residues corresponds to one of the amino acid sequences according to g), h) or i), the second stretch of amino acid residues corresponds to one of the amino acid sequences according to a), b), c), d), e) or f).

In this specific aspect, the amino acid sequence preferably comprises two or more stretches of amino acid residues chosen from the group consisting of:

i) the amino acid sequences of SEQ ID NOs: 197 to 267;
ii) the amino acid sequences of SEQ ID NOs: 339 to 409; and
iii) the amino acid sequences of SEQ ID NOs: 481 to 551;

such that, (i) when the first stretch of amino acid residues corresponds to one of the amino acid sequences of SEQ ID NOs: 197 to 267, the second stretch of amino acid residues corresponds to one of the amino acid sequences of SEQ ID NOs: 339 to 409 or of SEQ ID NOs: 481 to 551; (ii) when the first stretch of amino acid residues corresponds to one of the amino acid sequences of SEQ ID NOs: 339 to 409, the second stretch of amino acid residues corresponds to one of the amino acid sequences of SEQ ID NOs: 197 to 267 or of SEQ ID NOs: 481 to 551; or (iii) when the first stretch of amino acid residues corresponds to one of the amino acid sequences of SEQ ID NOs: 481 to 551, the second stretch of amino acid residues corresponds to one of the amino acid sequences of SEQ ID NOs: 197 to 267 or of SEQ ID NOs: 339 to 409.

Also, in such an amino acid sequence, the at least two stretches of amino acid residues again preferably form part of the antigen binding site for binding against any of IL-17A, IL-17F and/or IL-17A/F including combinations thereof.

In an even more specific, but non-limiting aspect, the invention relates to an amino acid sequence (or ISV) directed against any of IL-17A, IL-17F and/or IL-17A/F including combinations thereof, that comprises three or more stretches of amino acid residues, in which the first stretch of amino acid residues is chosen from the group consisting of:

a) the amino acid sequences of SEQ ID NOs: 197 to 267;
b) amino acid sequences that have at least 80% amino acid identity with at least one of the amino acid sequences of SEQ ID NOs: 197 to 267;
c) amino acid sequences that have 3, 2, or 1 amino acid difference with at least one of the amino acid sequences of SEQ ID NOs: 197 to 267;

the second stretch of amino acid residues is chosen from the group consisting of:

d) the amino acid sequences of SEQ ID NOs: 339 to 409;
e) amino acid sequences that have at least 80% amino acid identity with at least one of the amino acid sequences of SEQ ID NOs: 339 to 409;
f) amino acid sequences that have 3, 2, or 1 amino acid difference with at least one of the amino acid sequences of SEQ ID NOs: 339 to 409;

and the third stretch of amino acid residues is chosen from the group consisting of:

g) the amino acid sequences of SEQ ID NOs: 481 to 551;
h) amino acid sequences that have at least 80% amino acid identity with at least one of the amino acid sequences of SEQ ID NOs: 481 to 551;
i) amino acid sequences that have 3, 2, or 1 amino acid difference with at least one of the amino acid sequences of SEQ ID NOs: 481 to 551.

Preferably, in this specific aspect, the first stretch of amino acid residues is chosen from the group consisting of the amino acid sequences of SEQ ID NOs: 197 to 267; the second stretch of amino acid residues is chosen from the group consisting of the amino acid sequences of SEQ ID NOs: 339 to 409; and the third stretch of amino acid residues is chosen from the group consisting of the amino acid sequences of SEQ ID NOs: 481 to 551.

Again, preferably, in such an amino acid sequence, the at least three stretches of amino acid residues forms part of the antigen binding site for binding against any of IL-17A, IL-17F and/or IL-17A/F including combinations thereof.

Preferred combinations of such stretches of amino acid sequences will become clear from the further disclosure herein.

Preferably, in such amino acid sequences the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NOs: 623 to 693 (see Table A-1). This degree of amino acid identity can for example be determined by determining the degree of amino acid identity (in a manner described herein) between said amino acid sequence and one or more of the sequences of SEQ ID NOs: 623 to 693 (see Table A-1), in which the amino acid residues that form the framework regions are disregarded. Also, such amino acid sequences of the invention can be as further described herein.

Also, such amino acid sequences are preferably such that they can specifically bind (as defined herein) to any of IL-17A, IL-17F and/or IL-17A/F including combinations thereof; and more in particular bind to any of IL-17A, IL-17F and/or IL-17A/F including combinations thereof with an affinity (suitably measured and/or expressed as a $K_D$-value (actual or apparent), a $K_A$-value (actual or apparent), a $k_{on}$-rate and/or a $k_{off}$-rate, or alternatively as an IC50 value, as further described herein) that is as defined herein.

When the amino acid sequence (or ISV) of the invention essentially consists of 4 framework regions (FR1 to FR4, respectively) and 3 complementarity determining regions (CDR1 to CDR3, respectively), the amino acid sequence of the invention is preferably such that:

CDR1 is chosen from the group consisting of:

a) the amino acid sequences of SEQ ID NOs: 197 to 267;
b) amino acid sequences that have at least 80% amino acid identity with at least one of the amino acid sequences of SEQ ID NOs: 197 to 267;
c) amino acid sequences that have 3, 2, or 1 amino acid difference with at least one of the amino acid sequences of SEQ ID NOs: 197 to 267;

and/or

CDR2 is chosen from the group consisting of:

d) the amino acid sequences of SEQ ID NOs: 339 to 409;
e) amino acid sequences that have at least 80% amino acid identity with at least one of the amino acid sequences of SEQ ID NOs: 339 to 409;
f) amino acid sequences that have 3, 2, or 1 amino acid difference with at least one of the amino acid sequences of SEQ ID NOs: 339 to 409;

and/or

CDR3 is chosen from the group consisting of:

g) the amino acid sequences of SEQ ID NOs: 481 to 551;
h) amino acid sequences that have at least 80% amino acid identity with at least one of the amino acid sequences of SEQ ID NOs: 481 to 551;
i) amino acid sequences that have 3, 2, or 1 amino acid difference with at least one of the amino acid sequences of SEQ ID NOs: 481 to 551.

In particular, such an amino acid sequence (or ISV) of the invention may be such that CDR1 is chosen from the group consisting of the amino acid sequences of SEQ ID NOs: 197 to 267; and/or CDR2 is chosen from the group consisting of the amino acid sequences of SEQ ID NOs: 339 to 409; and/or CDR3 is chosen from the group consisting of the amino acid sequences of SEQ ID NOs: 481 to 551.

In particular, when the amino acid sequence (or ISV) of the invention essentially consists of 4 framework regions (FR1 to FR4, respectively) and 3 complementarity determining regions (CDR1 to CDR3, respectively), the amino acid sequence of the invention is preferably such that:

CDR1 is chosen from the group consisting of:

a) the amino acid sequences of SEQ ID NOs: 197 to 267;
b) amino acid sequences that have at least 80% amino acid identity with at least one of the amino acid sequences of SEQ ID NOs: 197 to 267;
c) amino acid sequences that have 3, 2, or 1 amino acid difference with at least one of the amino acid sequences of SEQ ID NOs: 197 to 267;

and

CDR2 is chosen from the group consisting of:

d) the amino acid sequences of SEQ ID NOs: 339 to 409;
e) amino acid sequences that have at least 80% amino acid identity with at least one of the amino acid sequences of SEQ ID NOs: 339 to 409;
f) amino acid sequences that have 3, 2, or 1 amino acid difference with at least one of the amino acid sequences of SEQ ID NOs: 339 to 409; and CDR3 is chosen from the group consisting of:

g) the amino acid sequences of SEQ ID NOs: 481 to 551;
h) amino acid sequences that have at least 80% amino acid identity with at least one of the amino acid sequences of SEQ ID NOs: 481 to 551;
i) amino acid sequences that have 3, 2, or 1 amino acid difference with at least one of the amino acid sequences of SEQ ID NOs: 481 to 551; or any suitable fragment of such an amino acid sequence In particular, such an amino acid sequence (or ISV) of the invention may be such that CDR1 is chosen from the group consisting of the amino acid sequences of SEQ ID NOs: 197 to 267; and CDR2 is chosen from the group consisting of the amino acid sequences of SEQ ID NOs: 339 to 409; and CDR3 is chosen from the group consisting of the amino acid sequences of SEQ ID NOs: 481 to 551.

Again, preferred combinations of CDR sequences will become clear from the further description herein.

Also, such amino acid sequences are preferably such that they can specifically bind (as defined herein) to any of IL-17A, IL-17F and/or IL-17A/F including combinations thereof; and more in particular bind to any of IL-17A, IL-17F and/or IL-17A/F including combinations thereof with an affinity (suitably measured and/or expressed as a $K_D$-value (actual or apparent), a $K_A$-value (actual or apparent), a $k_{on}$-rate and/or a $k_{off}$-rate, or alternatively as an IC50 value, as further described herein) that is as defined herein.

In one preferred, but non-limiting aspect, the invention relates to an amino acid sequence (or ISV) that essentially consists of 4 framework regions (FR1 to FR4, respectively) and 3 complementarity determining regions (CDR1 to CDR3, respectively), in which the CDR sequences of said amino acid sequence have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NOs: 623 to 693 (see Table A-1). This degree of amino acid identity can for example be determined by determining the degree of amino acid identity (in a manner described herein) between said amino acid sequence and one or more of the sequences of SEQ ID NOs: 623 to 693 (see Table A-1), in which the amino acid residues that form the framework regions are disregarded. Such amino acid sequences of the invention can be as further described herein.

In such an amino acid sequence of the invention, the framework sequences may be any suitable framework sequences, and examples of suitable framework sequences will be clear to the skilled person, for example on the basis the standard handbooks and the further disclosure and prior art mentioned herein.

The framework sequences are preferably (a suitable combination of) immunoglobulin framework sequences or framework sequences that have been derived from immunoglobulin framework sequences (for example, by humanization or camelization). For example, the framework sequences may be framework sequences derived from a light chain variable domain (e.g. a $V_L$-sequence) and/or from a heavy chain variable domain (e.g. a $V_H$-sequence). In one particularly preferred aspect, the framework sequences are either framework sequences that have been derived from a $V_{HH}$-sequence (in which said framework sequences may optionally have been partially or fully humanized) or are conventional $V_H$ sequences that have been camelized (as defined herein).

The framework sequences are preferably such that the amino acid sequence (or ISV) of the invention is a domain antibody (or an amino acid sequence that is suitable for use as a domain antibody); is a single domain antibody (or an amino acid sequence that is suitable for use as a single domain antibody); is a "dAb" (or an amino acid sequence that is suitable for use as a dAb); or is a Nanobody (including but not limited to $V_{HH}$ sequence). Again, suitable framework sequences will be clear to the skilled person, for example on the basis the standard handbooks and the further disclosure and prior art mentioned herein.

In particular, the framework sequences present in the amino acid sequences of the invention may contain one or more of Hallmark residues (as defined herein), such that the amino acid sequence of the invention is a Nanobody. Some preferred, but non-limiting examples of (suitable combinations of) such framework sequences will become clear from the further disclosure herein.

Again, as generally described herein for the amino acid sequences of the invention, it is also possible to use suitable fragments (or combinations of fragments) of any of the foregoing, such as fragments that contain one or more CDR sequences, suitably flanked by and/or linked via one or more framework sequences (for example, in the same order as these CDR's and framework sequences may occur in the full-sized immunoglobulin sequence from which the fragment has been derived). Such fragments may also again be such that they comprise or can form an immunoglobulin fold, or alternatively be such that they do not comprise or cannot form an immunoglobulin fold.

In one specific aspect, such a fragment comprises a single CDR sequence as described herein (and in particular a CDR3 sequence), that is flanked on each side by (part of) a framework sequence (and in particular, part of the framework sequence(s) that, in the immunoglobulin sequence from which the fragment is derived, are adjacent to said CDR sequence. For example, a CDR3 sequence may be preceded by (part of) a FR3 sequence and followed by (part of) a FR4 sequence). Such a fragment may also contain a disulphide bridge, and in particular a disulphide bridge that links the two framework regions that precede and follow the CDR sequence, respectively (for the purpose of forming such a disulphide bridge, cysteine residues that naturally occur in said framework regions may be used, or alternatively cysteine residues may be synthetically added to or introduced into said framework regions). For a further description of these "Expedite fragments", reference is again made to WO 03/050531, as well as WO2008/068280 (see also PCT/EP2009/054533).

In another aspect, the invention relates to a compound or construct, and in particular a protein or polypeptide (also referred to herein as a "compound of the invention" or "polypeptide of the invention", respectively) that comprises or essentially consists of one or more amino acid sequences (or ISV's) of the invention (or suitable fragments thereof), and optionally further comprises one or more other groups, residues, moieties or binding units. As will become clear to the skilled person from the further disclosure herein, such further groups, residues, moieties, binding units or amino acid sequences may or may not provide further functionality to the amino acid sequence of the invention (and/or to the compound or construct in which it is present) and may or may not modify the properties of the amino acid sequence of the invention.

For example, such further groups, residues, moieties or binding units may be one or more additional amino acid sequences, such that the compound or construct is a (fusion) protein or (fusion) polypeptide. In a preferred but non-limiting aspect, said one or more other groups, residues, moieties or binding units are immunoglobulin sequences. Even more preferably, said one or more other groups, residues, moieties or binding units are chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or Nanobodies.

Alternatively, such groups, residues, moieties or binding units may for example be chemical groups, residues, moieties, which may or may not by themselves be biologically and/or pharmacologically active. For example, and without limitation, such groups may be linked to the one or more amino acid sequences of the invention so as to provide a "derivative" of an amino acid sequence or polypeptide of the invention, as further described herein.

Also within the scope of the present invention are compounds or constructs, that comprises or essentially consists of one or more derivatives as described herein, and optionally further comprises one or more other groups, residues, moieties or binding units, optionally linked via one or more linkers. Preferably, said one or more other groups, residues, moieties or binding units are amino acid sequences.

In the compounds or constructs described above, the one or more amino acid sequences of the invention and the one or more groups, residues, moieties or binding units may be linked directly to each other and/or via one or more suitable linkers or spacers. For example, when the one or more groups, residues, moieties or binding units are amino acid sequences, the linkers may also be amino acid sequences, so that the resulting compound or construct is a fusion (protein) or fusion (polypeptide).

As will be clear from the further description above and herein, this means that the amino acid sequences (or ISV's) of the invention can be used as "building blocks" to form polypeptides of the invention, i.e. by suitably combining them with each other, one or more with other amino acid sequences of the invention and/or with one or more other groups, residues, moieties or binding units, in order to form compounds or constructs as described herein (such as, without limitations, the biparatopic. bi/multivalent and bi/multispecific polypeptides of the invention described herein) which combine within one molecule one or more desired properties or biological functions.

The compounds or polypeptides of the invention can generally be prepared by a method which comprises at least one step of suitably linking the one or more amino acid sequences (or ISV's) of the invention to the one or more further groups, residues, moieties or binding units, optionally via the one or more suitable linkers, so as to provide the compound or polypeptide of the invention. Polypeptides of the invention can also be prepared by a method which generally comprises at least the steps of providing a nucleic acid that encodes a polypeptide of the invention, expressing said nucleic acid in a suitable manner, and recovering the expressed polypeptide of the invention. Such methods can be performed in a manner known per se, which will be clear to the skilled person, for example on the basis of the methods and techniques further described herein.

The process of designing/selecting and/or preparing a compound or polypeptide of the invention, starting from an amino acid sequence (or ISV) of the invention, is also referred to herein as "formatting" said amino acid sequence of the invention; and an amino acid of the invention that is made part of a compound or polypeptide of the invention is said to be "formatted" or to be "in the format of" said compound or polypeptide of the invention. Examples of ways in which an amino acid sequence of the invention can be formatted and examples of such formats will be clear to the skilled person based on the disclosure herein; and such formatted amino acid sequences form a further aspect of the invention.

In one specific aspect of the invention, a compound of the invention or a polypeptide of the invention may have an increased half-life, compared to the corresponding amino acid sequence of the invention. Some preferred, but non-limiting examples of such compounds and polypeptides will become clear to the skilled person based on the further disclosure herein, and for example comprise amino acid sequences or polypeptides of the invention that have been chemically modified to increase the half-life thereof (for example, by means of pegylation); amino acid sequences of the invention that comprise at least one additional binding site for binding to a serum protein (such as serum albumin); or polypeptides of the invention that comprise at least one amino acid sequence of the invention that is linked to at least one moiety (and in particular at least one amino acid sequence) that increases the half-life of the amino acid sequence of the invention. Examples of polypeptides of the invention that comprise such half-life extending moieties or amino acid sequences will become clear to the skilled person based on the further disclosure herein; and for example include, without limitation, polypeptides in which the one or more amino acid sequences of the invention are suitable linked to one or more serum proteins or fragments thereof (such as (human) serum albumin or suitable fragments thereof) or to one or more binding units that can bind to serum proteins (such as, for example, domain antibodies, amino acid sequences that are suitable for use as a domain antibody, single domain antibodies, amino acid sequences that are suitable for use as a single domain antibody, "dAb"'s, amino acid sequences that are suitable for use as a dAb, or Nanobodies that can bind to serum proteins such as serum albumin (such as human serum albumin), serum immunoglobulins such as IgG, or transferrine; reference is made to the further description and references mentioned herein); polypeptides in which an amino acid sequence of the invention is linked to an Fc portion (such as a human Fc) or a suitable part or fragment thereof; or polypeptides in which the one or more amino acid sequences of the invention are suitable linked to one or more small proteins or peptides that can bind to serum proteins.

For example, a compound of the invention or a polypeptide of the invention may comprise one or more amino acid sequences of the invention (which may be as further described herein; and when two or more amino acid sequences of the invention are present, they may be the same or different) and one or more (usually only one, which may be a tandem repeat in case of a serum-albumin binding peptide) serum albumin binding peptides or serum albumin binding domains (and optionally one or more other groups, residues, moieties or binding units as further described herein). In such compounds or polypeptides of the invention, the "serum albumin binding peptide or binding domain" may be any suitable serum-albumin binding peptide or binding domain capable of increasing the half-life of the construct (compared to the same construct without the serum-albumin binding peptide or binding domain), and may in particular be serum albumin binding peptides as described in WO 2008/068280 by applicant (and in particular WO 2009/127691 and the non-prepublished U.S. application 61/301,819, both by applicant), or a serum-albumin binding immunoglobulin single variable domain (such as a serum-albumin binding Nanobody; for example Alb-1 or a humanized version of Alb-1 such as Alb-8, for which reference is for example made to WO 06/122787). Also Alb11 can be used. In one embodiment Alb11 has the amino acid sequence SEQ ID NO 841 or SEQ ID NO 842.

With respect to half-life, it should be noted that in the invention, and by using the various half-life extending techniques described herein (for example, by suitably choosing a serum-albumin binding peptide according to WO 2008/068280, WO 2009/127691 and/or the non-prepublished U.S. application 61/301,819), the half-life of a construct or polypeptide of the invention can (and preferably is) suitably "tailored" for the intended (therapeutic and/or diagnostic) application and/or to obtain the best balance between the desired therapeutic and/or pharmacological effect and possible undesired side-effects.

Generally, the compounds or polypeptides of the invention with increased half-life preferably have a half-life that is at least 1.5 times, preferably at least 2 times, such as at least 5 times, for example at least 10 times or more than 20 times, greater than the half-life of the corresponding amino acid sequence of the invention per se. For example, the compounds or polypeptides of the invention with increased half-life may have a half-life that is increased with more than 1 hours, preferably more than 2 hours, more preferably more than 6 hours, such as more than 12 hours, or even more than 24, 48 or 72 hours, compared to the corresponding amino acid sequence of the invention per se.

In a preferred, but non-limiting aspect of the invention, such compounds or polypeptides of the invention have a serum half-life that is increased with more than 1 hours, preferably more than 2 hours, more preferably more than 6 hours, such as more than 12 hours, or even more than 24, 48 or 72 hours, compared to the corresponding amino acid sequence of the invention per se.

In another preferred, but non-limiting aspect of the invention, such compounds or polypeptides of the invention exhibit a serum half-life in human of at least about 12 hours, preferably at least 24 hours, more preferably at least 48 hours, even more preferably at least 72 hours or more. For example, compounds or polypeptides of the invention may have a half-life of at least 5 days (such as about 5 to 10 days), preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days).

FIG. 6 and SEQ ID NOs: 710 to 759 as well as FIG. 8 and SEQ ID NOs: 826 to 837 give some preferred, but non-limiting examples of polypeptides of the invention, and each of these forms a further aspect of the present invention. All of these polypeptides contain an albumin-binding Nanobody (Alb-8, which is also referred to herein as Alb-11) according to WO 06/122787 in order to provide increase half-life. The polypeptides from FIG. 8 and SEQ ID NOs: 826 to 837 are based on humanized and/or sequenced-optimized amino acid sequences of the invention as building blocks. Based on the further disclosure herein, the skilled person will be able to provide other compounds, constructs and/or polypeptides of the invention, based on the same or other building blocks described herein, and/or comprising another moiety, binding domain, binding unit or peptide for providing increased half-life.

In another aspect, the invention relates to a nucleic acid that encodes an amino acid sequence (or ISV) of the invention or a polypeptide of the invention (or a suitable fragment thereof). Such a nucleic acid will also be referred to herein as a "nucleic acid of the invention" and may for example be in the form of a genetic construct, as further described herein. In a further preferred aspect, the amino acid of the invention (or ISV) is considered a building block.

In another aspect, the invention relates to a host or host cell that expresses (or that under suitable circumstances is capable of expressing) an amino acid sequence of the invention and/or a polypeptide of the invention; and/or that contains a nucleic acid of the invention. Some preferred but non-limiting examples of such hosts or host cells will become clear from the further description herein.

The invention further relates to a product or composition containing or comprising at least one amino acid sequence (or ISV) of the invention, at least one polypeptide of the invention (or a suitable fragment thereof) and/or at least one nucleic acid of the invention, and optionally one or more further components of such compositions known per se, i.e. depending on the intended use of the composition. Such a product or composition may for example be a pharmaceutical composition (as described herein), a veterinary composition or a product or composition for diagnostic use (as also described herein). Some preferred but non-limiting examples of such products or compositions will become clear from the further description herein.

The invention also relates to the use of an amino acid sequence (or ISV), Nanobody or polypeptide of the invention, or of a composition comprising the same, in (methods or compositions for) modulating any of IL-17A, IL-17F and/or IL-17A/F including combinations thereof, either in vitro (e.g. in an in vitro or cellular assay) or in vivo (e.g. in an a single cell or in a multicellular organism, and in particular in a mammal, and more in particular in a human being, such as in a human being that is at risk of or suffers from immune related diseases and disorders of the invention).

The invention also relates to methods for modulating IL-17A, IL-17F and/or IL-17A/F including combinations thereof, either in vitro (e.g. in an in vitro or cellular assay) or in vivo (e.g. in an a single cell or multicellular organism, and in particular in a mammal, and more in particular in a human being, such as in a human being that is at risk of or suffers from a immune related diseases and disorders of the invention), which method comprises at least the step of contacting IL-17A, IL-17F and/or IL-17A/F including combinations thereof with at least one amino acid sequence (or ISV), Nanobody or polypeptide of the invention, or with a composition comprising the same, in a manner and in an amount suitable to modulate IL-17A, IL-17F and/or IL-17A/F including combinations thereof, with at least one amino acid sequence (or ISV), Nanobody or polypeptide of the invention.

The invention also relates to the use of an one amino acid sequence (or ISV), Nanobody or polypeptide of the invention in the preparation of a composition (such as, without limitation, a pharmaceutical composition or preparation as further described herein) for modulating IL-17A, IL-17F and/or IL-17A/F including combinations thereof, either in vitro (e.g. in an in vitro or cellular assay) or in vivo (e.g. in an a single cell or multicellular organism, and in particular in a mammal, and more in particular in a human being, such as in a human being that is at risk of or suffers from the immune related diseases and disorders of the invention).

In the context of the present invention, "modulating" or "to modulate" generally means either reducing or inhibiting the activity of, or alternatively increasing the activity of, IL-17A, IL-17F and/or IL-17A/F including combinations thereof, as measured using a suitable in vitro, cellular or in vivo assay (such as those mentioned herein). In particular, "modulating" or "to modulate" may mean either reducing or inhibiting the activity of, or alternatively increasing the activity of IL-17A, IL-17F and/or IL-17A/F including combinations thereof, as measured using a suitable in vitro, cellular or in vivo assay (such as those mentioned herein), by at least 1%, preferably at least 5%, such as at least 10% or at least 25%, for example by at least 50%, at least 60%, at least 70%, at least 80%, or 90% or more, compared to activity of IL-17A, IL-17F and/or IL-17A/F including combinations thereof in the same assay under the same conditions but without the presence of the amino acid sequence, Nanobody or polypeptide of the invention.

As will be clear to the skilled person, "modulating" may also involve effecting a change (which may either be an increase or a decrease) in affinity, avidity, specificity and/or selectivity of any of IL-17A, IL-17F and/or IL-17A/F including combinations thereof for one or more of its targets, ligands or substrates; and/or effecting a change (which may either be an increase or a decrease) in the sensitivity of IL-17A, IL-17F and/or IL-17A/F including combinations thereof for one or more conditions in the medium or surroundings in which IL-17A, IL-17F and/or IL-17A/F including combinations thereof is present (such as pH, ion strength, the presence of co-factors, etc.), compared to the same conditions but without the presence of the amino acid sequence (or ISV), Nanobody or polypeptide of the invention. As will be clear to the skilled person, this may again be determined in any suitable manner and/or using any suitable assay known per se, such as the assays described herein or in the prior art cited herein.

"Modulating" may also mean effecting a change (i.e. an activity as an agonist or as an antagonist, respectively) with respect to one or more biological or physiological mechanisms, effects, responses, functions, pathways or activities in which IL-17A, IL-17F and/or IL-17A/F including combinations thereof (or in which its substrate(s), ligand(s) or pathway(s) are involved, such as its signalling pathway or metabolic pathway and their associated biological or physiological effects) is involved. Again, as will be clear to the skilled person, such an action as an agonist or an antagonist may be determined in any suitable manner and/or using any suitable (in vitro and usually cellular or in assay) assay known per se, such as the assays described herein or in the prior art cited herein. In particular, an action as an agonist or antagonist may be such that an intended biological or physiological activity is increased or decreased, respectively, by at least 1%, preferably at least 5%, such as at least 10% or at least 25%, for example by at least 50%, at least 60%, at least 70%, at least 80%, or 90% or more, compared to the biological or physiological activity in the same assay under the same conditions but without the presence of the amino acid sequence (or ISV), Nanobody or polypeptide of the invention.

Modulating may for example involve reducing or inhibiting the binding of any of IL-17A, IL-17F and/or IL-17A/F including combinations thereof to one of its substrates or ligands and/or competing with a natural ligand, substrate for binding to any of IL-17A, IL-17F and/or IL-17A/F including combinations thereof. Modulating may also involve activating any of IL-17A, IL-17F and/or IL-17A/F including combinations thereof or the mechanism or pathway in which it is involved. Modulating may be reversible or irreversible, but for pharmaceutical and pharmacological purposes will usually be in a reversible manner.

The invention further relates to methods for preparing or generating the amino acid sequences (or ISV), polypeptides, nucleic acids, host cells, products and compositions described herein. Some preferred but non-limiting examples of such methods will become clear from the further description herein.

Generally, these methods may comprise the steps of:

a) providing a set, collection or library of amino acid sequences; and b) screening said set, collection or library of amino acid sequences for amino acid sequences that can bind to and/or have affinity for any of IL-17A, IL-17F and/or IL-17A/F including combinations thereof;

and c) isolating the amino acid sequence(s) that can bind to and/or have affinity for any of IL-17A, IL-17F and/or IL-17A/F including combinations thereof.

In such a method, the set, collection or library of amino acid sequences may be any suitable set, collection or library of amino acid sequences. For example, the set, collection or library of amino acid sequences may be a set, collection or library of immunoglobulin sequences (as described herein), such as a naïve set, collection or library of immunoglobulin sequences; a synthetic or semi-synthetic set, collection or library of immunoglobulin sequences; and/or a set, collection or library of immunoglobulin sequences that have been subjected to affinity maturation.

Also, in such a method, the set, collection or library of amino acid sequences may be a set, collection or library of heavy chain variable domains (such as $V_H$ domains or $V_{HH}$ domains) or of light chain variable domains. For example, the set, collection or library of amino acid sequences may be a set, collection or library of domain antibodies or single domain antibodies or ISVs, or may be a set, collection or library of amino acid sequences that are capable of functioning as a domain antibody or single domain antibody or ISV.

In a preferred aspect of this method, the set, collection or library of amino acid sequences may be an immune set, collection or library of immunoglobulin sequences, for example derived from a mammal that has been suitably immunized with any of IL-17A, IL-17F and/or IL-17A/F including combinations thereof or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

In the above methods, the set, collection or library of amino acid sequences may be displayed on a phage, phagemid, ribosome or suitable micro-organism (such as yeast), such as to facilitate screening. Suitable methods, techniques and host organisms for displaying and screening (a set, collection or library of) amino acid sequences will be clear to the person skilled in the art, for example on the basis of the further disclosure herein. Reference is also made to the review by Hoogenboom in Nature Biotechnology, 23, 9, 1105-1116 (2005).

In another aspect, the method for generating amino acid sequences comprises at least the steps of:

a) providing a collection or sample of cells expressing amino acid sequences;

b) screening said collection or sample of cells for cells that express an amino acid sequence that can bind to and/or have affinity for any of IL-17A, IL-17F and/or IL-17A/F including combinations thereof;

and c) either (i) isolating said amino acid sequence; or (ii) isolating from said cell a nucleic acid sequence that encodes said amino acid sequence, followed by expressing said amino acid sequence.

For example, when the desired amino acid sequence is an immunoglobulin sequence, the collection or sample of cells may for example be a collection or sample of B-cells. Also, in this method, the sample of cells may be derived from a mammal that has been suitably immunized with any of IL-17A, IL-17F and/or IL-17A/F including combinations thereof or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

The above method may be performed in any suitable manner, as will be clear to the skilled person. Reference is for example made to EP 0 542 810, WO 05/19824, WO 04/051268 and WO 04/106377. The screening of step b) is preferably performed using a flow cytometry technique such as FACS. For this, reference is for example made to Lieby et al., Blood, Vol. 97, No. 12, 3820 (2001).

In another aspect, the method for generating an amino acid sequence directed against any of IL-17A, IL-17F and/or IL-17A/F including combinations thereof may comprise at least the steps of:

a) providing a set, collection or library of nucleic acid sequences encoding amino acid sequences;

b) screening said set, collection or library of nucleic acid sequences for nucleic acid sequences that encode an amino acid sequence that can bind to and/or has affinity for any of IL-17A, IL-17F and/or IL-17A/F including combinations thereof;

and c) isolating said nucleic acid sequence, followed by expressing said amino acid sequence.

In such a method, the set, collection or library of nucleic acid sequences encoding amino acid sequences may for example be a set, collection or library of nucleic acid sequences encoding a naïve set, collection or library of immunoglobulin sequences; a set, collection or library of nucleic acid sequences encoding a synthetic or semi-synthetic set, collection or library of immunoglobulin sequences; and/or a set, collection or library of nucleic acid sequences encoding a set, collection or library of immunoglobulin sequences that have been subjected to affinity maturation.

Also, in such a method, the set, collection or library of nucleic acid sequences may encode a set, collection or library of heavy chain variable domains (such as $V_H$ domains or $V_{HH}$ domains) or of light chain variable domains. For example, the set, collection or library of nucleic acid sequences may encode a set, collection or library of domain antibodies or single domain antibodies, or a set, collection or library of amino acid sequences that are capable of functioning as a domain antibody or single domain antibody.

In a preferred aspect of this method, the set, collection or library of nucleic acid sequences may be an immune set, collection or library of nucleic acid sequences, for example derived from a mammal that has been suitably immunized with any of IL-17A, IL-17F and/or IL-17A/F including combinations thereof or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

The set, collection or library of nucleic acid sequences may for example encode an immune set, collection or library of heavy chain variable domains or of light chain variable domains. In one specific aspect, the set, collection or library of nucleotide sequences may encode a set, collection or library of $V_{HH}$ sequences.

In the above methods, the set, collection or library of nucleotide sequences may be displayed on a phage, phagemid, ribosome or suitable micro-organism (such as yeast), such as to facilitate screening. Suitable methods, techniques and host organisms for displaying and screening (a set, collection or library of) nucleotide sequences encoding amino acid sequences will be clear to the person skilled in the art, for example on the basis of the further disclosure herein. Reference is also made to the review by Hoogenboom in Nature Biotechnology, 23, 9, 1105-1116 (2005).

In another aspect, the method for generating an amino acid sequence directed against any of IL-17A, IL-17F and/or IL-17A/F including combinations thereof may comprise at least the steps of:

a) providing a set, collection or library of nucleic acid sequences encoding amino acid sequences;
b) screening said set, collection or library of nucleic acid sequences for nucleic acid sequences that encode an amino acid sequence that can bind to and/or has affinity for any of IL-17A, IL-17F and/or IL-17A/F including combinations thereof and that is cross-blocked or is cross blocking a Nanobody of the invention, e.g. SEQ ID NO: 623 to 693 (Table A-1), or a humanized Nanobody of the invention, or a polypeptide or construct of the invention; and
c) isolating said nucleic acid sequence, followed by expressing said amino acid sequence.

The invention also relates to amino acid sequences that are obtained by the above methods, or alternatively by a method that comprises one of the above methods and in addition at least the steps of determining the nucleotide sequence or amino acid sequence of said immunoglobulin sequence; and of expressing or synthesizing said amino acid sequence in a manner known per se, such as by expression in a suitable host cell or host organism or by chemical synthesis.

Also, following the steps above, one or more amino acid sequences of the invention may be suitably humanized (or alternatively camelized); and/or the amino acid sequence(s) thus obtained may be linked to each other or to one or more other suitable amino acid sequences (optionally via one or more suitable linkers) so as to provide a polypeptide of the invention. Also, a nucleic acid sequence encoding an amino acid sequence of the invention may be suitably humanized (or alternatively camelized) and suitably expressed; and/or one or more nucleic acid sequences encoding an amino acid sequence of the invention may be linked to each other or to one or more nucleic acid sequences that encode other suitable amino acid sequences (optionally via nucleotide sequences that encode one or more suitable linkers), after which the nucleotide sequence thus obtained may be suitably expressed so as to provide a polypeptide of the invention.

The invention further relates to applications and uses of the amino acid sequences, compounds, constructs, polypeptides, nucleic acids, host cells, products and compositions described herein, as well as to methods for the prevention and/or treatment for diseases and disorders associated with any of IL-17A, IL-17F and/or IL-17A/F including combinations thereof. Some preferred but non-limiting applications and uses will become clear from the further description herein.

The invention also relates to the amino acid sequences, compounds, constructs, polypeptides, nucleic acids, host cells, products and compositions described herein for use in therapy.

In particular, the invention also relates to the amino acid sequences, compounds, constructs, polypeptides, nucleic acids, host cells, products and compositions described herein for use in therapy of a disease or disorder that can be prevented or treated by administering, to a subject in need thereof, of (a pharmaceutically effective amount of) an amino acid sequence, compound, construct or polypeptide as described herein.

More in particular, the invention relates to the amino acid sequences, compounds, constructs, polypeptides, nucleic acids, host cells, products and compositions described herein for use in therapy of immune related diseases and disorders of the invention.

Other aspects, embodiments, advantages and applications of the invention will also become clear from the further description herein, in which the invention will be described and discussed in more detail with reference to the Nanobodies of the invention and polypeptides of the invention comprising the same, which form some of the preferred aspects of the invention.

As will become clear from the further description herein, Nanobodies generally offer certain advantages (outlined herein) compared to "dAb's" or similar (single) domain antibodies or immunoglobulin sequences, which advantages are also provided by the Nanobodies of the invention. However, it will be clear to the skilled person that the more general aspects of the teaching below can also be applied (either directly or analogously) to other amino acid sequences of the invention.

DETAILED DESCRIPTION OF THE INVENTION

In the present description, examples and claims:

a) Unless indicated or defined otherwise, all terms used have their usual meaning in the art, which will be clear to the skilled person. Reference is for example made to the standard handbooks mentioned in paragraph a) on page 46 of WO 08/020,079.
b) Unless indicated otherwise, the terms "immunoglobulin sequence", "sequence", "nucleotide sequence" and "nucleic acid" are as described in paragraph b) on page 46 of WO 08/020,079.
c) Unless indicated otherwise, all methods, steps, techniques and manipulations that are not specifically described in detail can be performed and have been performed in a manner known per se, as will be clear to the skilled person. Reference is for example again made to the standard handbooks and the general background art mentioned herein and to the further references cited therein; as well as to for example the following reviews Presta, Adv. Drug Deliv. Rev. 2006, 58 (5-6): 640-56; Levin and Weiss, Mol. Biosyst. 2006, 2(1): 49-57; Irving et al., J. Immunol. Methods, 2001, 248(1-2), 31-45; Schmitz et al., Placenta, 2000, 21 Suppl. A, S106-12, Gonzales et al., Tumour Biol., 2005, 26(1), 31-43, which describe techniques for protein engineering, such as affinity maturation and other techniques for improving the specificity and other desired properties of proteins such as immunoglobulins.
d) Amino acid residues will be indicated according to the standard three-letter or one-letter amino acid code. Reference is made to Table A-2 on page 48 of the International application WO 08/020,079 of Ablynx N.V. entitled "Amino acid sequences directed against IL-6R and polypeptides comprising the same for the treatment of diseases and disorders associated with 11-6 mediated signalling".

e) For the purposes of comparing two or more nucleotide sequences, the percentage of "sequence identity" between a first nucleotide sequence and a second nucleotide sequence may be calculated or determined as described in paragraph e) on page 49 of WO 08/020,079 (incorporated herein by reference), such as by dividing [the number of nucleotides in the first nucleotide sequence that are identical to the nucleotides at the corresponding positions in the second nucleotide sequence] by [the total number of nucleotides in the first nucleotide sequence] and multiplying by [100%], in which each deletion, insertion, substitution or addition of a nucleotide in the second nucleotide sequence—compared to the first nucleotide sequence—is considered as a difference at a single nucleotide (position); or using a suitable computer algorithm or technique, again as described in paragraph e) on pages 49 of WO 08/020,079 (incorporated herein by reference).

f) For the purposes of comparing two or more amino acid sequences, the percentage of "sequence identity" between a first amino acid sequence and a second amino acid sequence (also referred to herein as "amino acid identity") may be calculated or determined as described in paragraph 0 on pages 49 and 50 of WO 08/020,079 (incorporated herein by reference), such as by dividing [the number of amino acid residues in the first amino acid sequence that are identical to the amino acid residues at the corresponding positions in the second amino acid sequence] by [the total number of amino acid residues in the first amino acid sequence] and multiplying by [100%], in which each deletion, insertion, substitution or addition of an amino acid residue in the second amino acid sequence—compared to the first amino acid sequence—is considered as a difference at a single amino acid residue (position), i.e. as an "amino acid difference" as defined herein; or using a suitable computer algorithm or technique, again as described in paragraph f) on pages 49 and 50 of WO 08/020,079 (incorporated herein by reference).

Also, in determining the degree of sequence identity between two amino acid sequences, the skilled person may take into account so-called "conservative" amino acid substitutions, as described on page 50 of WO 08/020,079.

Any amino acid substitutions applied to the polypeptides described herein may also be based on the analysis of the frequencies of amino acid variations between homologous proteins of different species developed by Schulz et al., Principles of Protein Structure, Springer-Verlag, 1978, on the analyses of structure forming potentials developed by Chou and Fasman, Biochemistry 13: 211, 1974 and Adv. Enzymol., 47: 45-149, 1978, and on the analysis of hydrophobicity patterns in proteins developed by Eisenberg et al., Proc. Nad. Acad. Sci. USA 81: 140-144, 1984; Kyte & Doolittle; J Molec. Biol. 157: 105-132, 198 1, and Goldman et al., Ann. Rev. Biophys. Chem. 15: 321-353, 1986, all incorporated herein in their entirety by reference. Information on the primary, secondary and tertiary structure of Nanobodies is given in the description herein and in the general background art cited above. Also, for this purpose, the crystal structure of a $V_{HH}$ domain from a llama is for example given by Desmyter et al., Nature Structural Biology, Vol. 3, 9, 803 (1996); Spinelli et al., Natural Structural Biology (1996); 3, 752-757; and Decanniere et al., Structure, Vol. 7, 4, 361 (1999). Further information about some of the amino acid residues that in conventional $V_H$ domains form the $V_H/V_L$ interface and potential camelizing substitutions on these positions can be found in the prior art cited above.

g) Amino acid sequences and nucleic acid sequences are said to be "exactly the same" if they have 100% sequence identity (as defined herein) over their entire length.

h) When comparing two amino acid sequences, the term "amino acid difference" refers to an insertion, deletion or substitution of a single amino acid residue on a position of the first sequence, compared to the second sequence; it being understood that two amino acid sequences can contain one, two or more such amino acid differences.

i) When a nucleotide sequence or amino acid sequence is said to "comprise" another nucleotide sequence or amino acid sequence, respectively, or to "essentially consist of" another nucleotide sequence or amino acid sequence, this has the meaning given in paragraph i) on pages 51-52 of WO 08/020,079.

j) The term "in essentially isolated form" has the meaning given to it in paragraph j) on pages 52 and 53 of WO 08/020,079.

k) The terms "domain" and "binding domain" have the meanings given to it in paragraph k) on page 53 of WO 08/020,079.

l) The terms "antigenic determinant" and "epitope", which may also be used interchangeably herein, have the meanings given to it in paragraph 1) on page 53 of WO 08/020,079. An epitope in the context of the present invention includes any peptide or peptide-derivative determinant capable of specific binding to an amino acid sequence of the invention. An epitope may comprise any suitable number of amino acids, in any suitable position (with respect to the linear sequence of IL17A and/or IL17F and/or IL17A/F), orientation (with respect to folded IL17A and/or IL17F and/or IL17A/F), or a fragment thereof, amino acid composition (and consequently, at least in part, charge). Thus, for example, an epitope may be composed of about 3-10 amino acids, typically 3-8 amino acids, in one or more contiguous or noncontiguous locations with respect to the primary sequence of IL17A and/or IL17F and/or IL17A/F (for instance an epitope may consist essentially of 2, 3, 4, 5, 6, 7, or 8 amino acid residues distributed in 1, 2, 3, 4, or 5 noncontiguous locations in CD38). Alternatively, for example, an epitope may be considered to be defined by a region of about 5-40 contiguous amino acid residues (e.g., about 7-30 amino acid residues, about 5-20 amino acid residues, or about 3-15 amino acid residues) in IL17A and/or IL17F and/or IL17A/F (solely or in combination with a portion of an adjacent CD38 domain). In some epitopes it may be the case that just one amino acid residue or only a few amino acid residues are critical to CDR or CDR(s) recognition (and thereby most important to binding to IL17A and/or IL17F and/or IL17A/F, for antigen affinity and avidity). As such, an epitope may be characterized on the basis of one or more of such critical residues, with the recognition that other residues may also make some lesser contribution to the epitope. In the case of an epitope defined by a region of amino acids, it may be that one or more amino acids in the region make only a minor contribution or even negligible contribution to antibody binding, such that the residue may be subject to substitution with an appropriate different residue without resulting in "a loss" of the epitope to at least some amino acid sequences of the invention specific for it.

m) As further described in paragraph m) on page 53 of WO 08/020,079, an amino acid sequence (such as a Nanobody, an antibody, a polypeptide of the invention, or generally an antigen binding protein or polypeptide or a fragment thereof) that can (specifically) bind to, that has affinity for and/or that has specificity for a specific antigenic determinant, epitope, antigen or protein (or for at least one part, fragment or epitope thereof) is said to be "against" or "directed against" said antigenic determinant, epitope, antigen or protein.

n) The term "specificity" has the meaning given to it in paragraph n) on pages 53-56 of WO 08/020,079; and as mentioned therein refers to the number of different types of antigens or antigenic determinants to which a particular antigen-binding molecule or antigen-binding protein (such as a Nanobody or a polypeptide of the invention) molecule can bind. Such binding properties in the context of the amino acid sequences of the present invention is sometimes referred to as "binding specifically" throughout the present document. Wherever the term "binding specifically" occurs in the present document it denotes binding properties of an amino acid sequence of the present invention which binding to a target exhibits such specificity as explained in this paragraph. The specificity of an antigen-binding protein can be determined based on affinity and/or avidity, as described on pages 53-56 of WO 08/020,079 (incorporated herein by reference), which also describes some preferred techniques for measuring binding between an antigen-binding molecule (such as a Nanobody or polypeptide of the invention) and the pertinent antigen. Typically, antigen-binding proteins (such as the amino acid sequences, Nanobodies and/or polypeptides of the invention) will bind to their antigen with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles). Any $K_D$ value greater than $10^4$ mol/liter (or any $K_A$ value lower than $10^4$ $M^{-1}$) liters/mol is generally considered to indicate non-specific binding. Preferably, a monovalent immunoglobulin sequence of the invention will bind to the desired antigen with an affinity less than 500 nM, preferably less than 200 nM, more preferably less than 10 nM, such as less than 500 pM. Specific binding of an antigen-binding protein to an antigen or antigenic determinant can be determined in any suitable manner known per se, including, for example, Scatchard analysis and/or competitive binding assays, such as radioimmunoassays (RIA), enzyme immunoassays (EIA) and sandwich competition assays, and the different variants thereof known per se in the art; as well as the other techniques mentioned herein. As will be clear to the skilled person, and as described on pages 53-56 of WO 08/020,079, the dissociation constant may be the actual or apparent dissociation constant. Methods for determining the dissociation constant will be clear to the skilled person, and for example include the techniques mentioned on pages 53-56 of WO 08/020,079.

o) The half-life of an amino acid sequence, compound or polypeptide of the invention can generally be defined as described in paragraph o) on page 57 of WO 08/020,079 and as mentioned therein refers to the time taken for the serum concentration of the amino acid sequence, compound or polypeptide to be reduced by 50%, in vivo, for example due to degradation of the sequence or compound and/or clearance or sequestration of the sequence or compound by natural mechanisms. The in vivo half-life of an amino acid sequence, compound or polypeptide of the invention can be determined in any manner known per se, such as by pharmacokinetic analysis. Suitable techniques will be clear to the person skilled in the art, and may for example generally be as described in paragraph o) on page 57 of WO 08/020,079. As also mentioned in paragraph o) on page 57 of WO 08/020,079, the half-life can be expressed using parameters such as the t½-alpha, t½-beta and the area under the curve (AUC). Reference is for example made to the Experimental Part below, as well as to the standard handbooks, such as Kenneth, A et al: Chemical Stability of Pharmaceuticals: A Handbook for Pharmacists and Peters et al, Pharmacokinete analysis: A Practical Approach (1996). Reference is also made to "Pharmacokinetics", M Gibaldi & D Perron, published by Marcel Dekker, 2nd Rev. edition (1982). The terms "increase in half-life" or "increased half-life" as also as defined in paragraph o) on page 57 of WO 08/020,079 and in particular refer to an increase in the t½-beta, either with or without an increase in the t½-alpha and/or the AUC or both.

p) In the context of the present invention, "modulating" or "to modulate" generally means either reducing or inhibiting the activity of, or alternatively increasing the activity of, a target or antigen, as measured using a suitable in vitro, cellular or in vivo assay. In particular, "modulating" or "to modulate" may mean either reducing or inhibiting the activity of, or alternatively increasing a (relevant or intended) biological activity of, a target or antigen, as measured using a suitable in vitro, cellular or in vivo assay (which will usually depend on the target or antigen involved), by at least 1%, preferably at least 5%, such as at least 10% or at least 25%, for example by at least 50%, at least 60%, at least 70%, at least 80%, or 90% or more, compared to activity of the target or antigen in the same assay under the same conditions but without the presence of the construct of the invention.

As will be clear to the skilled person, "modulating" may also involve effecting a change (which may either be an increase or a decrease) in affinity, avidity, specificity and/or selectivity of a target or antigen for one or more of its ligands, binding partners, partners for association into a homomultimeric or heteromultimeric form, or substrates; and/or effecting a change (which may either be an increase or a decrease) in the sensitivity of the target or antigen for one or more conditions in the medium or surroundings in which the target or antigen is present (such as pH, ion strength, the presence of co-factors, etc.), compared to the same conditions but without the presence of the construct of the invention. As will be clear to the skilled person, this may again be determined in any suitable manner and/or using any suitable assay known per se, depending on the target or antigen involved.

"Modulating" may also mean effecting a change (i.e. an activity as an agonist, as an antagonist or as a reverse agonist, respectively, depending on the target or antigen and the desired biological or physiological effect) with respect to one or more biological or physiological mechanisms, effects, responses, functions, pathways or activities in which the target or antigen (or in which its substrate(s), ligand(s) or pathway(s) are involved, such as its signalling pathway or metabolic pathway and their associated biological or physiological effects) is involved. Again, as will be clear to the skilled person, such an action as an agonist or an antagonist may be determined in any suitable manner and/or using any suitable (in vitro and usually cellular or in assay) assay known per se, depending on the target or antigen involved. In particular, an action as an agonist or antagonist may be such that an intended biological or physiological activity is increased or decreased, respectively, by at least 1%, preferably at least 5%, such as at least 10% or at least 25%, for example by at least 50%, at least 60%, at least 70%, at least 80%, or 90% or more, compared to the biological or physiological activity in the same assay under the same conditions but without the presence of the construct of the invention.

Modulating may for example also involve allosteric modulation of the target or antigen; and/or reducing or inhibiting the binding of the target or antigen to one of its substrates or ligands and/or competing with a natural ligand, substrate for binding to the target or antigen. Modulating may also involve activating the target or antigen or the mechanism or pathway in which it is involved. Modulating may for example also involve effecting a change in respect of the folding or confirmation of the target or antigen, or in respect of the ability of the target or antigen to fold, to change its confirmation (for example, upon binding of a ligand), to associate with other (sub)units, or to disassociate. Modulating may for example also involve effecting a change in the ability of the target or antigen to transport other compounds or to serve as a channel for other compounds (such as ions).

Modulating may be reversible or irreversible, but for pharmaceutical and pharmacological purposes will usually be in a reversible manner.

q) In respect of a target or antigen, the term "interaction site" on the target or antigen means a site, epitope, antigenic determinant, part, domain or stretch of amino acid residues on the target or antigen that is a site for binding to a ligand, receptor or other binding partner, a catalytic site, a cleavage site, a site for allosteric interaction, a site involved in multimerisation (such as homomerization or heterodimerization) of the target or antigen; or any other site, epitope, antigenic determinant, part, domain or stretch of amino acid residues on the target or antigen that is involved in a biological action or mechanism of the target or antigen. More generally, an "interaction site" can be any site, epitope, antigenic determinant, part, domain or stretch of amino acid residues on the target or antigen to which an amino acid sequence or polypeptide of the invention can bind such that the target or antigen (and/or any pathway, interaction, signalling, biological mechanism or biological effect in which the target or antigen is involved) is modulated (as defined herein).

r) An amino acid sequence or polypeptide is said to be "specific for" a first target or antigen compared to a second target or antigen when is binds to the first antigen with an affinity (as described above, and suitably expressed as a $K_D$ value, $K_A$ value, $K_{off}$ rate and/or $K_{on}$ rate) that is at least 10 times, such as at least 100 times, and preferably at least 1000 times, and up to 10.000 times or more better than the affinity with which said amino acid sequence or polypeptide binds to the second target or polypeptide. For example, the first antigen may bind to the target or antigen with a $K_D$ value that is at least 10 times less, such as at least 100 times less, and preferably at least 1000 times less, such as 10.000 times less or even less than that, than the $K_D$ with which said amino acid sequence or polypeptide binds to the second target or polypeptide. Preferably, when an amino acid sequence or polypeptide is "specific for" a first target or antigen compared to a second target or antigen, it is directed against (as defined herein) said first target or antigen, but not directed against said second target or antigen.

s) The terms "cross-block", "cross-blocked" and "cross-blocking" are used interchangeably herein to mean the ability of an amino acid sequence or other binding agents (such as a Nanobody, polypeptide or compound or construct of the invention) to interfere with the binding of other amino acid sequences or binding agents of the invention to a given target. The extend to which an amino acid sequence or other binding agents of the invention is able to interfere with the binding of another to the target, and therefore whether it can be said to cross-block according to the invention, can be determined using competition binding assays. One particularly suitable quantitative cross-blocking assay uses a Biacore machine which can measure the extent of interactions using surface plasmon resonance technology. Another suitable quantitative cross-blocking assay uses an ELISA-based approach to measure competition between amino acid sequences or other binding agents in terms of their binding to the target.

The following generally describes a suitable Biacore assay for determining whether an amino acid sequence or other binding agent cross-blocks or is capable of cross-blocking according to the invention. It will be appreciated that the assay can be used with any of the amino acid sequences or other binding agents described herein. The Biacore machine (for example the Biacore 3000) is operated in line with the manufacturer's recommendations. Thus in one cross-blocking assay, the target protein is coupled to a CM5 Biacore chip using standard amine coupling chemistry to generate a surface that is coated with the target. Typically 200-800 resonance units of the target would be coupled to the chip (an amount that gives easily measurable levels of binding but that is readily saturable by the concentrations of test reagent being used). Two test amino acid sequences (termed A* and B*) to be assessed for their ability to cross-block each other are mixed at a one to one molar ratio of binding sites in a suitable buffer to create the test mixture. When calculating the concentrations on a binding site basis the molecular weight of an amino acid sequence is assumed to be the total molecular weight of the amino acid sequence divided by the number of target binding sites on that amino acid sequence. The concentration of each amino acid sequence in the test mix should be high enough to readily saturate the binding sites for that amino acid sequence on the target molecules captured on the Biacore chip. The amino acid sequences in the mixture are at the same molar concentration (on a binding basis) and that concentration would typically be between 1.00 and 1.5 micromolar (on a binding site basis). Separate solutions containing A* alone and B* alone are also prepared. A* and B* in these solutions should be in the same buffer and at the same concentration as in the test mix. The test mixture is passed over the target-coated Biacore chip and the total amount of binding recorded. The chip is then treated in such a way as to remove the bound amino acid sequences without damaging the chip-bound target. Typically this is done by treating the chip with 30 mM HCl for 60 seconds. The solution of A* alone is then passed over the target-coated surface and the amount of binding recorded. The chip is again treated to remove all of the bound amino acid sequences without damaging the chip-bound target. The solution of B* alone is then passed over the target-coated surface and the amount of binding recorded. The maximum theoretical binding of the mixture of A* and B* is next calculated, and is the sum of the binding of each amino acid sequence when passed over the target surface alone. If the actual recorded binding of the mixture is less than this theoretical maximum then the two amino acid sequences are cross-blocking each other. Thus, in general, a cross-blocking amino acid sequence or other binding agent according to the invention is one which will bind to the target in the above Biacore cross-blocking assay such that, during the assay and in the presence of a second amino acid sequence or other binding agent of the invention, the recorded binding is between 80% and 0.1% (e.g. 80% to 4%) of the maximum theoretical binding, specifically between 75% and 0.1% (e.g. 75% to 4%) of the maximum theoretical binding, and more specifically between 70% and 0.1% (e.g. 70% to 4%) of maximum theoretical binding (as just defined above) of the two amino acid sequences or binding agents in combination. The Biacore assay described above is a primary assay used to determine if amino acid sequences or other binding agents cross-block each other according to the invention. On rare occasions particular amino acid sequences or other binding agents may not bind to target coupled via amine chemistry to a CM5 Biacore chip (this usually occurs when the relevant binding site on target is masked or destroyed by the coupling to the chip). In such cases cross-blocking can be determined using a tagged version of the target, for example a N-terminal His-tagged version. In this particular format, an anti-His amino acid sequence would be coupled to the Biacore chip and then the His-tagged target would be passed over the surface of the chip and captured by the anti-His amino acid sequence. The cross blocking analysis would be carried out essentially as described above, except that after each chip regeneration cycle, new His-tagged target would be loaded back onto the anti-His amino acid sequence coated surface. In addition to the example given using N-terminal His-tagged target, C-terminal His-tagged target could alternatively be used. Furthermore, various other tags and tag binding protein combinations that are known in the art could be used for such a cross-blocking analysis (e.g. HA tag with anti-HA antibodies; FLAG tag with anti-FLAG antibodies; biotin tag with streptavidin).

The following generally describes an ELISA assay for determining whether an amino acid sequence or other binding agent directed against a target cross-blocks or is capable of cross-blocking as defined herein. It will be appreciated that the assay can be used with any of the amino acid sequences (or other binding agents such as polypeptides of the invention) described herein. The general principal of the assay is to have an amino acid sequence or binding agent that is directed against the target coated onto the wells of an ELISA plate. An excess amount of a second, potentially cross-blocking, anti-target amino acid sequence is added in solution (i.e. not bound to the ELISA plate). A limited amount of the target is then added to the wells. The coated amino acid sequence and the amino acid sequence in solution compete for binding of the limited number of target molecules. The plate is washed to remove excess target that has not been bound by the coated amino acid sequence and to also remove the second, solution phase amino acid sequence as well as any complexes formed between the second, solution phase amino acid sequence and target. The amount of bound target is then measured using a reagent that is appropriate to detect the target. An amino acid sequence in solution that is able to cross-block the coated amino acid sequence will be able to cause a decrease in the number of target molecules that the coated amino acid sequence can bind relative to the number of target molecules that the coated amino acid sequence can bind in the absence of the second, solution phase, amino acid sequence. In the instance where the first amino acid sequence, e.g. an Ab-X, is chosen to be the immobilized amino acid sequence, it is coated onto the wells of the ELISA plate, after which the plates are blocked with a suitable blocking solution to minimize non-specific binding of reagents that are subsequently added. An excess amount of the second amino acid sequence, i.e. Ab-Y, is then added to the ELISA plate such that the moles of Ab-Y target binding sites per well are at least 10 fold higher than the moles of Ab-X target binding sites that were used, per well, during the coating of the ELISA plate. Target is then added such that the moles of target added per well are at least 25-fold lower than the moles of Ab-X target binding sites that were used for coating each well. Following a suitable incubation period the ELISA plate is washed and a reagent for detecting the target is added to measure the amount of target specifically bound by the coated anti[target amino acid sequence (in this case Ab-X). The background signal for the assay is defined as the signal obtained in wells with the coated amino acid sequence (in this case Ab-X), second solution phase amino acid sequence (in this case Ab-Y), target buffer only (i.e. without target) and target detection reagents. The positive control signal for the assay is defined as the signal obtained in wells with the coated amino acid sequence (in this case Ab-X), second solution phase amino acid sequence buffer only (i.e. without second solution phase amino acid sequence), target and target detection reagents. The ELISA assay may be run in such a manner so as to have the positive control signal be at least 6 times the background signal. To avoid any artefacts (e.g. significantly different affinities between Ab-X and Ab-Y for the target) resulting from the choice of which amino acid sequence to use as the coating amino acid sequence and which to use as the second (competitor) amino acid sequence, the cross-blocking assay may to be run in two formats: 1) format 1 is where Ab-X is the amino acid sequence that is coated onto the ELISA plate and Ab-Y is the competitor amino acid sequence that is in solution and 2) format 2 is where Ab-Y is the amino acid sequence that is coated onto the ELISA plate and Ab-X is the competitor amino acid sequence that is in solution. Ab-X and Ab-Y are defined as cross-blocking if, either in format 1 or in format 2, the solution phase anti-target amino acid sequence is able to cause a reduction of between 60% and 100%, specifically between 70% and 100%, and more specifically between 80% and 100%, of the target detection signal {i.e. the amount of target bound by the coated amino acid sequence) as compared to the target detection signal obtained in the absence of the solution phase anti-target amino acid sequence (i.e. the positive control wells).

t) An amino acid sequence is said to be "cross-reactive" for two different antigens or antigenic determinants (such as serum albumin from two different species of mammal, such as human serum albumin and cyno serum albumin) if it is specific for (as defined herein) both these different antigens or antigenic determinants.

u) By binding that is "essentially independent of the pH" is generally meant herein that the association constant ($K_A$) of the amino acid sequence with respect to the serum protein (such as serum albumin) at the pH value(s) that occur in a cell of an animal or human body (as further described herein) is at least 5%, such as at least 10%, preferably at least 25%, more preferably at least 50%, even more preferably at least 60%, such as even more preferably at least 70%, such as at least 80% or 90% or more (or even more than 100%, such as more than 110%, more than 120% or even 130% or more, or even more than 150%, or even more than 200%) of the association constant ($K_A$) of the amino acid sequence with respect to the same serum protein at the pH value(s) that occur outside said cell. Alternatively, by binding that is "essentially independent of the pH" is generally meant herein that the $k_{off}$ rate (measured by Biacore) of the amino acid sequence with respect to the serum protein (such as serum albumin) at the pH value(s) that occur in a cell of an animal or human body (as e.g. further described herein, e.g. pH around 5.5, e.g. 5.3 to 5.7) is at least 5%, such as at least 10%, preferably at least 25%, more preferably at least 50%, even more preferably at least 60%, such as even more preferably at least 70%, such as at least 80% or 90% or more (or even more than 100%, such as more than 110%, more than 120% or even 130% or more, or even more than 150%, or even more than 200%) of the $k_{off}$ rate of the amino acid sequence with respect to the same serum protein at the pH value(s) that occur outside said cell, e.g. pH 7.2 to 7.4. By "the pH value(s) that occur in a cell of an animal or human body" is meant the pH value(s) that may occur inside a cell, and in particular inside a cell that is involved in the recycling of the serum protein. In particular, by "the pH value(s) that occur in a cell of an animal or human body" is meant the pH value(s) that may occur inside a (sub)cellular compartment or vesicle that is involved in recycling of the serum protein (e.g. as a result of pinocytosis, endocytosis, transcytosis, exocytosis and phagocytosis or a similar mechanism of uptake or internalization into said cell), such as an endosome, lysosome or pinosome.

v) As further described herein, the total number of amino acid residues in a Nanobody can be in the region of 110-120, is preferably 112-115, and is most preferably 113. It should however be noted that parts, fragments, analogs or derivatives (as further described herein) of a Nanobody are not particularly limited as to their length and/or size, as long as such parts, fragments, analogs or derivatives meet the further requirements outlined herein and are also preferably suitable for the purposes described herein;

w) As further described in paragraph q) on pages 58 and 59 of WO 08/020,079 (incorporated herein by reference), the amino acid residues of a Nanobody are numbered according to the general numbering for $V_H$ domains given by Kabat et al. ("Sequence of proteins of immunological interest", US Public Health Services, NIH Bethesda, Md., Publication No. 91), as applied to $V_{HH}$ domains from Camelids in the article of Riechmann and Muyldermans, J. Immunol. Methods 2000 Jun. 23; 240 (1-2): 185-195 (see for example FIG. 2 of this publication), and accordingly FR1 of a Nanobody comprises the amino acid residues at positions 1-30, CDR1 of a Nanobody comprises the amino acid residues at positions 31-35, FR2 of a Nanobody comprises the amino acids at positions 36-49, CDR2 of a Nanobody comprises the amino acid residues at positions 50-65, FR3 of a Nanobody comprises the amino acid residues at positions 66-94, CDR3 of a Nanobody comprises the amino acid residues at positions 95-102, and FR4 of a Nanobody comprises the amino acid residues at positions 103-113.

x) The Figures, Sequence Listing and the Experimental Part/Examples are only given to further illustrate the invention and should not be interpreted or construed as limiting the scope of the invention and/or of the appended claims in any way, unless explicitly indicated otherwise herein.

For a general description of heavy chain antibodies and the variable domains thereof, reference is inter alia made to the prior art cited herein, as well as to the prior art mentioned on page 59 of WO 08/020,079 and to the list of references mentioned on pages 41-43 of the International application WO 06/040153, which prior art and references are incorporated herein by reference.

In accordance with the terminology used in the art (see the above references), the variable domains present in naturally occurring heavy chain antibodies will also be referred to as "$V_{HH}$ domains", in order to distinguish them from the heavy chain variable domains that are present in conventional 4-chain antibodies (which will be referred to hereinbelow as "$V_H$ domains") and from the light chain variable domains that are present in conventional 4-chain antibodies (which will be referred to hereinbelow as "$V_L$ domains").

As mentioned in the prior art referred to above, $V_{HH}$ domains have a number of unique structural characteristics and functional properties which make isolated $V_{HH}$ domains (as well as Nanobodies based thereon, which share these structural characteristics and functional properties with the naturally occurring $V_{HH}$ domains) and proteins containing the same highly advantageous for use as functional antigen-binding domains or proteins. In particular, and without being limited thereto, $V_{HH}$ domains (which have been "designed" by nature to functionally bind to an antigen without the presence of, and without any interaction with, a light chain variable domain) and Nanobodies can function as a single, relatively small, functional antigen-binding structural unit, domain or protein. This distinguishes the $V_{HH}$ domains from the $V_H$ and $V_L$ domains of conventional 4-chain antibodies, which by themselves are generally not suited for practical application as single antigen-binding proteins or domains, but need to be combined in some form or another to provide a functional antigen-binding unit (as in for example conventional antibody fragments such as Fab fragments; in ScFv's fragments, which consist of a $V_H$ domain covalently linked to a $V_L$ domain).

Because of these unique properties, the use of $V_{HH}$ domains and Nanobodies as single antigen-binding proteins or as antigen-binding domains (i.e. as part of a larger protein or polypeptide) offers a number of significant advantages over the use of conventional $V_H$ and $V_L$ domains, scFv's or conventional antibody fragments (such as Fab- or F(ab')-2-fragments), including the advantages that are listed on pages 60 and 61 of WO 08/020,079.

In a specific and preferred aspect, the invention provides Nanobodies against any of IL-17A, IL-17F and/or IL-17A/F including combinations thereof, and in particular Nanobodies against any of IL-17A, IL-17F and/or IL-17A/F including combinations thereof from a warm-blooded animal, and more in particular Nanobodies against any of IL-17A, IL-17F and/or IL-17A/F including combinations thereof from a mammal, and especially Nanobodies against human any of IL-17A, IL-17F and/or IL-17A/F including combinations thereof; as well as proteins and/or polypeptides comprising at least one such Nanobody.

In particular, the invention provides Nanobodies against any of IL-17A, IL-17F and/or IL-17A/F including combinations thereof, and proteins and/or polypeptides comprising the same, that have improved therapeutic and/or pharmacological properties and/or other advantageous properties (such as, for example, improved ease of preparation and/or reduced costs of goods), compared to conventional antibodies against any of IL-17A, IL-17F and/or IL-17A/F including combinations thereof or fragments thereof, compared to constructs that could be based on such conventional antibodies or antibody fragments (such as Fab' fragments, $F(ab')_2$ fragments, ScFv constructs, “diabodies” and other multispecific constructs (see for example the review by Holliger and Hudson, Nat. Biotechnol. 2005 September; 23(9):1126-36)), and also compared to the so-called “dAb’s” or similar (single) domain antibodies that may be derived from variable domains of conventional antibodies. These improved and advantageous properties will become clear from the further description herein, and for example include, without limitation, one or more of:

- increased affinity and/or avidity for any of IL-17A, IL-17F and/or IL-17A/F including combinations thereof, either in a monovalent format, in a multivalent format (for example in a bivalent format) and/or in a multispecific format (for example one of the multispecific formats described hereinbelow);
- better suitability for formatting in a multivalent format (for example in a bivalent format);
- better suitability for formatting in a multispecific format (for example one of the multispecific formats described hereinbelow);
- improved suitability or susceptibility for “humanizing” substitutions (as defined herein);
- less immunogenicity, either in a monovalent format, in a multivalent format (for example in a bivalent format) and/or in a multispecific format (for example one of the multispecific formats described hereinbelow);
- increased stability, either in a monovalent format, in a multivalent format (for example in a bivalent format) and/or in a multispecific format (for example one of the multispecific formats described hereinbelow);
- increased specificity towards any of IL-17A, IL-17F and/or IL-17A/F including combinations thereof, either in a monovalent format, in a multivalent format (for example in a bivalent format) and/or in a multispecific format (for example one of the multispecific formats described hereinbelow);
- decreased or where desired increased cross-reactivity with any of IL-17A, IL-17F and/or IL-17A/F including combinations thereof from different species;

and/or

- one or more other improved properties desirable for pharmaceutical use (including prophylactic use and/or therapeutic use) and/or for diagnostic use (including but not limited to use for imaging purposes), either in a monovalent format, in a multivalent format (for example in a bivalent format) and/or in a multispecific format (for example one of the multispecific formats described hereinbelow).

As generally described herein for the amino acid sequences of the invention, the Nanobodies of the invention are preferably in essentially isolated form (as defined herein), or form part of a protein or polypeptide of the invention (as defined herein), which may comprise or essentially consist of one or more Nanobodies of the invention and which may optionally further comprise one or more further amino acid sequences (all optionally linked via one or more suitable linkers). For example, and without limitation, the one or more amino acid sequences (or ISV’s) of the invention may be used as a binding unit in such a protein or polypeptide, which may optionally contain one or more further amino acid sequences (or ISV’s) that can serve as a binding unit (i.e. against one or more other targets than any of IL-17A, IL-17F and/or IL-17A/F including combinations thereof), so as to provide a monovalent, multivalent or multispecific polypeptide of the invention, respectively, all as described herein. In particular, such a protein or polypeptide may comprise or essentially consist of one or more Nanobodies (or ISV’s) of the invention and optionally one or more (other) Nanobodies (ISV’s), i.e. directed against other targets than any of IL-17A, IL-17F and/or IL-17A/F including combinations thereof, all optionally linked via one or more suitable linkers, so as to provide a monovalent, multivalent or multispecific Nanobody construct, respectively, as further described herein. Such proteins or polypeptides may also be in essentially isolated form (as defined herein).

In a Nanobody (or ISV) of the invention, the binding site for binding against any of IL-17A, IL-17F and/or IL-17A/F including combinations thereof is preferably formed by the CDR sequences. Optionally, a Nanobody (or ISV) of the invention may also, and in addition to the at least one binding site for binding against any of IL-17A, IL-17F and/or IL-17A/F including combinations thereof, contain one or more further binding sites for binding against other antigens, proteins or targets. For methods and positions for introducing such second binding sites, reference is for example made to Keck and Huston, Biophysical Journal, 71, October 1996, 2002-2011; EP 0 640 130; and WO 06/07260.

As generally described herein for the amino acid sequences of the invention, when a Nanobody (or ISV) of the invention (or a polypeptide of the invention comprising the same) is intended for administration to a subject (for example for therapeutic and/or diagnostic purposes as described herein), it is preferably directed against any of human IL-17A, IL-17F and/or IL-17A/F including combinations thereof; whereas for veterinary purposes, it is preferably directed against any of IL-17A, IL-17F and/or IL-17A/F including combinations thereof from the species to be treated. Also, as with the amino acid sequences of the invention, a Nanobody (or ISV) of the invention may or may not be cross-reactive (i.e. directed against any of IL-17A, IL-17F and/or IL-17A/F including combinations thereof from two or more species of mammal, such as against any of human IL-17A, IL-17F and/or IL-17A/F including combinations thereof and any of IL-17F and/or IL-17A/F including combinations thereof from at least one of the species of mammal mentioned herein).

Also, again as generally described herein for the amino acid sequences of the invention, the Nanobodies (or ISV’s) of the invention may generally be directed against any antigenic determinant, epitope, part, domain, subunit or confirmation (where applicable) of any of IL-17A, IL-17F and/or IL-17A/F including combinations thereof. However, it is generally assumed and preferred that the Nanobodies (or ISV’s) of the invention (and polypeptides comprising the same) are directed against the epitopes of the invention such as described herein.

As already described herein, the amino acid sequence and structure of a Nanobody (or ISV) can be considered—without however being limited thereto—to be comprised of four framework regions or "FR's" (or sometimes also referred to as "FW's"), which are referred to in the art and herein as "Framework region 1" or "FR1"; as "Framework region 2" or "FR2"; as "Framework region 3" or "FR3"; and as "Framework region 4" or "FR4", respectively; which framework regions are interrupted by three complementary determining regions or "CDR's", which are referred to in the art as "Complementarity Determining Region 1" or "CDR1"; as "Complementarity Determining Region 2" or "CDR2"; and as "Complementarity Determining Region 3" or "CDR3", respectively. Some preferred framework sequences and CDR's (and combinations thereof) that are present in the Nanobodies (or ISV's) of the invention are as described herein. Other suitable CDR sequences can be obtained by the methods described herein.

According to a non-limiting but preferred aspect of the invention, (the CDR sequences present in) the Nanobodies (or ISV's) of the invention are such that:

the Nanobodies (or ISV's) can bind to any of IL-17A, IL-17F and/or IL-17A/F including combinations thereof with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);

and/or such that:

the Nanobodies (or ISV's) can bind to any of IL-17A, IL-17F and/or IL-17A/F including combinations thereof with a $k_{on}$-rate of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$;

and/or such that they:

the Nanobodies (or ISV's) can bind to any of IL-17A, IL-17F and/or IL-17A/F including combinations thereof with a $k_{off}$ rate between 1 $s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Preferably, (the CDR sequences present in) the Nanobodies (or ISV's) of the invention are such that: a monovalent Nanobody (or ISV) of the invention (or a polypeptide that contains only one Nanobody (or ISV) of the invention) is preferably such that it will bind to any of IL-17A, IL-17F and/or IL-17A/F including combinations thereof with an affinity less than 500 nM, preferably less than 200 nM, more preferably less than 10 nM, such as less than 500 pM.

The affinity of the Nanobody (or ISV) of the invention against any of IL-17A, IL-17F and/or IL-17A/F including combinations thereof can be determined in a manner known per se, for example using the general techniques for measuring $K_D$, $K_A$, $k_{off}$ or $k_{on}$, mentioned herein, as well as some of the specific assays described herein.

Some preferred IC50 values for binding of the Nanobodies (or ISV's) of the invention (and of polypeptides comprising the same) to any of IL-17A, IL-17F and/or IL-17A/F including combinations thereof will become clear from the further description and examples herein.

In a preferred but non-limiting aspect, the invention relates to a Nanobody (or ISV) (as defined herein) against any of IL-17A, IL-17F and/or IL-17A/F including combinations thereof, which consists of 4 framework regions (FR1 to FR4 respectively) and 3 complementarity determining regions (CDR1 to CDR3 respectively), in which:

CDR1 is chosen from the group consisting of:

a) the amino acid sequences of SEQ ID NOs: 197 to 267;
b) amino acid sequences that have at least 80% amino acid identity with at least one of the amino acid sequences of SEQ ID NOs: 197 to 267;
c) amino acid sequences that have 3, 2, or 1 amino acid difference with at least one of the amino acid sequences of SEQ ID NOs: 197 to 267;

and/or

CDR2 is chosen from the group consisting of:

d) the amino acid sequences of SEQ ID NOs: 339 to 409;
e) amino acid sequences that have at least 80% amino acid identity with at least one of the amino acid sequences of SEQ ID NOs: 339 to 409;
f) amino acid sequences that have 3, 2, or 1 amino acid difference with at least one of the amino acid sequences of SEQ ID NOs: 339 to 409;

and/or

CDR3 is chosen from the group consisting of:

g) the amino acid sequences of SEQ ID NOs: 481 to 551,
h) amino acid sequences that have at least 80% amino acid identity with at least one of the amino acid sequences of SEQ ID NOs: 481 to 551;
i) amino acid sequences that have 3, 2, or 1 amino acid difference with at least one of the amino acid sequences of SEQ ID NOs: 481 to 551;

or any suitable fragment of such an amino acid sequence.

In particular, according to this preferred but non-limiting aspect, the invention relates to a Nanobody (or ISV) (as defined herein) against any of IL-17A, IL-17F and/or IL-17A/F including combinations thereof, which consists of 4 framework regions (FR1 to FR4 respectively) and 3 complementarity determining regions (CDR1 to CDR3 respectively), in which:

CDR1 is chosen from the group consisting of:

a) the amino acid sequences of SEQ ID NOs: 197 to 267;
b) amino acid sequences that have at least 80% amino acid identity with at least one of the amino acid sequences of SEQ ID NOs: 197 to 267;
c) amino acid sequences that have 3, 2, or 1 amino acid difference with at least one of the amino acid sequences of SEQ ID NOs: 197 to 267;

and

CDR2 is chosen from the group consisting of:

d) the amino acid sequences of SEQ ID NOs: 339 to 409;
e) amino acid sequences that have at least 80% amino acid identity with at least one of the amino acid sequences of SEQ ID NOs: 339 to 409;
f) amino acid sequences that have 3, 2, or 1 amino acid difference with at least one of the amino acid sequences of SEQ ID NOs: 339 to 409;

and

CDR3 is chosen from the group consisting of:

g) the amino acid sequences of SEQ ID NOs: 481 to 551;
h) amino acid sequences that have at least 80% amino acid identity with at least one of the amino acid sequences of SEQ ID NOs: 481 to 551;
i) amino acid sequences that have 3, 2, or 1 amino acid difference with at least one of the amino acid sequences of SEQ ID NOs: 481 to 551;

or any suitable fragment of such an amino acid sequences.

As generally mentioned herein for the amino acid sequences of the invention, when a Nanobody (or ISV) of the invention contains one or more CDR1 sequences according to b) and/or c):

i) any amino acid substitution in such a CDR according to b) and/or c) is preferably, and compared to the corresponding CDR according to a), a conservative amino acid substitution (as defined herein);

and/or ii) the CDR according to b) and/or c) preferably only contains amino acid substitutions, and no amino acid deletions or insertions, compared to the corresponding CDR according to a);

and/or iii) the CDR according to b) and/or c) may be a CDR that is derived from a CDR according to a) by means of affinity maturation using one or more techniques of affinity maturation known per se.

Similarly, when a Nanobody (or ISV) of the invention contains one or more CDR2 sequences according to e) and/or f):

i) any amino acid substitution in such a CDR according to e) and/or f) is preferably, and compared to the corresponding CDR according to d), a conservative amino acid substitution (as defined herein);

and/or ii) the CDR according to e) and/or f) preferably only contains amino acid substitutions, and no amino acid deletions or insertions, compared to the corresponding CDR according to d);

and/or iii) the CDR according to e) and/or f) may be a CDR that is derived from a CDR according to d) by means of affinity maturation using one or more techniques of affinity maturation known per se.

Also, similarly, when a Nanobody (or ISV) of the invention contains one or more CDR3 sequences according to h) and/or i):

i) any amino acid substitution in such a CDR according to h) and/or i) is preferably, and compared to the corresponding CDR according to g), a conservative amino acid substitution (as defined herein);

and/or ii) the CDR according to h) and/or i) preferably only contains amino acid substitutions, and no amino acid deletions or insertions, compared to the corresponding CDR according to g);

and/or iii) the CDR according to h) and/or i) may be a CDR that is derived from a CDR according to g) by means of affinity maturation using one or more techniques of affinity maturation known per se.

It should be understood that the last three paragraphs generally apply to any Nanobody (or ISV) of the invention that comprises one or more CDR1 sequences, CDR2 sequences and/or CDR3 sequences according to b), c), e), f), h) or i), respectively.

Of the Nanobodies (or ISV's) of the invention, Nanobodies (or ISV's) comprising one or more of the CDR's explicitly listed above are particularly preferred; Nanobodies (or ISV's) comprising two or more of the CDR's explicitly listed above are more particularly preferred; and Nanobodies (or ISV's) comprising three of the CDR's explicitly listed above are most particularly preferred.

Some particularly preferred, but non-limiting combinations of CDR sequences, as well as preferred combinations of CDR sequences and framework sequences, are mentioned in Table B-1 below, which lists the CDR sequences and framework sequences that are present in a number of preferred (but non-limiting) Nanobodies (or ISV's) of the invention. As will be clear to the skilled person, a combination of CDR1, CDR2 and CDR3 sequences that occur in the same clone (i.e. CDR', CDR2 and CDR3 sequences that are mentioned on the same line in Table B-1) will usually be preferred (although the invention in its broadest sense is not limited thereto, and also comprises other suitable combinations of the CDR sequences mentioned in Table B-1). Also, a combination of CDR sequences and framework sequences that occur in the same clone (i.e. CDR sequences and framework sequences that are mentioned on the same line, e.g. same row, in Table B-1) will usually be preferred (although the invention in its broadest sense is not limited thereto, and also comprises other suitable combinations of the CDR sequences and framework sequences mentioned in Table B-1, e.g. from different rows, as well as combinations of such CDR sequences and other suitable framework sequences, e.g. as further described herein).

Also, in the Nanobodies (or ISV's) of the invention that comprise any of the combinations of CDR's mentioned in Table B-1, each CDR can be replaced by a CDR chosen from the group consisting of amino acid sequences that have at least 80%, preferably at least 90%, more preferably at least 95%, even more preferably at least 99% sequence identity (as defined herein) with the mentioned CDR's; in which:

i) any amino acid substitution in such a CDR is preferably, and compared to the corresponding CDR sequence mentioned in Table B-1, a conservative amino acid substitution (as defined herein);

and/or ii) any such CDR sequence preferably only contains amino acid substitutions, and no amino acid deletions or insertions, compared to the corresponding CDR sequence mentioned in Table B-1;

and/or iii) any such CDR sequence is a CDR that is derived by means of a technique for affinity maturation known per se, and in particular starting from the corresponding CDR sequence mentioned in Table B-1.

However, as will be clear to the skilled person, the (combinations of) CDR sequences, as well as (the combinations of) CDR sequences and framework sequences mentioned in Table B-1 will generally be preferred.

TABLE B-1

Preferred combinations of CDR sequences, preferred combinations of framework sequences, and preferred combinations of framework and CDR sequences. ("ID" refers to the SEQ ID NO as used herein)

| | ID | FR1 | ID | CDR1 | ID | FR2 | ID | CDR2 | ID | FR3 | ID | CDR3 | ID | FR4 |
|---|---|---|---|---|---|---|---|---|---|---|---|---|---|---|
| 01D02 | 126 | EVQLVESGGGL VQAGGSLRLSC AASGLSFS | 197 | SYALG | 268 | WFRQAPG KERDFVA | 339 | AINWSGDNTHYA DSVKG | 410 | RFTISRDNAKNTVS LQMNSLKPEDTAV YYCAA | 481 | QLGYESGYS LTYDYDY | 552 | WGQGTQV TVSS |
| 01G03 | 127 | EVQLVESGGGL VQAGGSLRLSC AASERTIS | 198 | NYDMG | 269 | WFRQAPG KERELIA | 340 | ADISWSALNTNY ADSVKG | 411 | RFTISRDNAKNMV YLQMNNLKPEDTA VYYCAA | 482 | RRSGYASFD N | 553 | WGQGTQV TVSS |

TABLE B-1-continued

Preferred combinations of CDR sequences, preferred combinations of framework sequences, and preferred combinations of framework and CDR sequences. ("ID" refers to the SEQ ID NO as used herein)

| | ID | FR1 | ID | CDR1 | ID | FR2 | ID | CDR2 | ID | FR3 | ID | CDR3 | ID | FR4 |
|---|---|---|---|---|---|---|---|---|---|---|---|---|---|---|
| 02E03 | 128 | EVQLVESGGGLVQPGGSLRLSCAASGFTFS | 199 | SYAMS | 270 | WARQAPGEGLEWVS | 341 | DINSGGTRTTYADSVKG | 412 | RFTISRDNAKNTLYLQMNSLKPEDTAVYYCAK | 483 | LSVFRSQLGGKYYGGDYEN | 554 | RGQGTQVTVSS |
| 03B08 | 129 | EVQLVESGGGLVQAGGSLRLSCAASGFTFD | 200 | DYAIG | 271 | WFRQAPGKEREGVS | 342 | CISSSDGSIYYADSVKG | 413 | RFTISSDNAKNTVYLQMNSLKPEDTAVYHCAR | 484 | FGRTGWAEECVDYDY | 555 | WGQGTQVTVSS |
| 03E05 | 130 | EVQLVESGGGLVQAGGSLRLSCAASGVTFD | 201 | DYSIG | 272 | WFRQAPGKEREGVS | 343 | CISSSDGIPYYSDFVKG | 414 | RFTTSIDNAKNTVYLQMNSLKPEDTAVYYCAA | 485 | GFGRLCAEFDS | 556 | WGQGTQVTVSS |
| 01D06 | 131 | EVQLVESGGGLVQAGGSLRLSCAADGRTFS | 202 | TYGMT | 273 | WFRQVPGKEREFVA | 344 | HIPRSTYSPYYANSVKG | 415 | RFTIARDDAKSTVYLQMNSLKPEDTAVYYCAV | 486 | FTGGTYYVPTAYDY | 557 | WGQGTQVTVSS |
| 02A08 | 132 | EVQLVESGGGVVQPGGSLRLSCADSERSFS | 203 | FNAMG | 274 | WFRQAPGKEREFVA | 345 | AISATGDDTYYADSVKG | 416 | RFAISRDTARNTVYLQMNSLKPEDTAVYYCGA | 487 | RVNFDGTVSYTNDYAY | 558 | WGQGTQVTVSS |
| 02A10 | 133 | EVQLVESGGGLVQPGGSLRLSCAASGFALG | 204 | YYAIG | 275 | WFRQAPGKEREGVS | 346 | CDSSSDGRTYYGDSVKG | 417 | RFTISTDSAKNTVYLQMNSLKPEDTAVYYCAT | 488 | CTDFEYDY | 559 | WGQGTQVTVSS |
| 04B09 | 134 | EVQLVESGGGLVQPGGSLRLSCAASGFTLG | 205 | YYAIG | 276 | WFRQAPGKEREGVS | 347 | CDSSSDGDTYYANSVKG | 418 | RFTISTDNGKNTVYLQMNSLKPEDTAVYYCAT | 489 | CTDWNYDY | 560 | WGQGTQVTVSS |
| 03C07 | 125 | EVQLVESGGGLVQAGGSLRLSCAASGFTFD | 206 | DYAIG | 277 | WFRQAPGKEREAVS | 348 | CFSSSDGSIYYADSVKG | 419 | RFTISSDNAKNTVYLQMNSLKPEDTAVYYCAG | 490 | GGGSYYYTQLNYCYDMDY | 561 | WGKGTQVTVSS |
| 04A02 | 136 | EVQLVESGGGLVQPGGSLRLSCAASRNINI | 207 | INYMA | 278 | WYRQAPGNQRELVA | 349 | AMTSDATTEYADSVKG | 420 | RFTISRDIPENTVYLQMNSLKPEDTAVYYCNA | 491 | KGIWDYLGRRDFGDY | 562 | WGQGTQVTVSS |
| 04B10 | 137 | EVQLVESGGGLVQAGGSQSLSCVASGTIVN | 208 | INVMG | 279 | WYRQAPGKQRELVA | 350 | LTTSGGGTTYGDSVKG | 421 | RFTISIDNAKNTVILQMNSLEAEDTAVYYCAA | 492 | EIGYYSGGTYFSSEAH | 563 | WGQGTQVTVSS |
| 04G01 | 138 | EVQLVESGGGLVQAGGSQRLSCTASGTIVN | 209 | IHVMG | 280 | WYRQAPGKQRELVA | 351 | LIFSGGSADYADSVKG | 422 | RFTISRDNAKNTVYLEMNSLKAEDTAVYYCAA | 493 | EIGYYSGGTYYSSEAH | 564 | WGQGTQVTVSS |
| 04F09 | 139 | EVQLVESGGGLVQPGGSLRLSCAASGRTFS | 210 | THAMG | 281 | WFRQAPGKERDFVA | 352 | AIRWSDGSSFYADSVKG | 423 | RFTISRDNAKNAVYLQSNSLKSEDTAVYVCYA | 494 | DVEGPTALHKY | 565 | WGRGTQVTVSS |
| 09D10 | 140 | EVQLVESGGGLVQAGGSLSLSCAASGSVFR | 211 | IDVMR | 282 | WHRQAPGKQREFLA | 353 | SIASGGTTNYADSVKG | 424 | RFTISRDNAKNTVYLQMNSLKPEDTAVYYCGA | 495 | NAESGPYTY | 566 | WGLGTQVTVSS |
| 09G10 | 141 | EVQLVESGGGLVQAGGSLRLSCAASDSVFT | 212 | AKAVG | 283 | WYRQPPGLQREWVA | 354 | IITSGGKTNYADSVKG | 425 | RFTVSVDKVKNTVTLQMNSLKPEDTAVYYCYA | 496 | QWMGRDY | 567 | WGQGTQVTVSS |
| 11A06 | 142 | EVQLVESGGGLVQPGESLRLSCKASGFSLD | 213 | YYALG | 284 | WFRQAPGKEREGIS | 355 | CITSSDASAYYTDSVKG | 426 | RFTISRDNSKNTVYLQMNSLKTEDTAIYYCAA | 497 | ALLTCSSYYDAYTY | 568 | WGQGTQVTVSS |
| 06E11 | 143 | EVQLVESGGGLVQAGGSLRLSCPVSGRAFS | 214 | RGRLG | 285 | WFRQAPGKEREFVA | 356 | VAHWSGAITSYADSVKG | 427 | RFTFSRDNAKNTMNLQMNSLKPEDTAVYYCAA | 498 | DSETSGNWVY | 569 | WGQGTQVTVSS |
| 07B09 | 144 | EVQLVESGGGLVQAGGSLRLSCGASGGTFS | 215 | SYATG | 286 | WFRQAPGKEREFVA | 357 | VLRWSDGHTAYADSVKG | 428 | RFTISRDGAKNTMYLQMSSLKPEDTAIYYCTT | 499 | ATRPGEWDY | 570 | WGQGTQVTVSS |
| 24G10 | 145 | EVQLVESGGGLVQAGGSLRLSCGAAGGTFS | 216 | SYATG | 287 | WFRQAPGKEREFVA | 358 | VFRWSDSHTAYADSVKG | 429 | RFTISRDGAKNTLYLQMSSLKPEDTAIYYCTT | 500 | ATRPGEWDY | 571 | WGQGTQVTVSS |

TABLE B-1-continued

Preferred combinations of CDR sequences, preferred combinations of framework sequences, and preferred combinations of framework and CDR sequences. ("ID" refers to the SEQ ID NO as used herein)

| | ID | FR1 | ID | CDR1 | ID | FR2 | ID | CDR2 | ID | FR3 | ID | CDR3 | ID | FR4 |
|---|---|---|---|---|---|---|---|---|---|---|---|---|---|---|
| 07B11 | 146 | EVQLVESGGGLVQAGGSLRLSCVASGRAFS | 217 | SYVMG | 288 | WFRQAPGMEREFVA | 359 | LIRWSDGITGYVDSVKG | 430 | RFTISRDNAKNTVYLQMNSLKPEDTAVYYCAA | 501 | AVRPGDYDY | 572 | WGQGTQVTVSS |
| 08A08 | 147 | EVQLVESGGGLVQAGGSLRLSCAASGRTFR | 218 | PYRMG | 289 | WFRRAPGKAREFVT | 360 | LISWSSGRTSYADSVKG | 431 | RFTISRDSAKNAVYLQMDNLKPEDTAVYFCAV | 502 | DLSGDAVYDS | 573 | WGQGTQVTVSS |
| 08B07 | 148 | EVQLVESGGGLVQPGGSLRLSCAASGRDFR | 219 | VKNVG | 290 | WIRQAPGKQRELVA | 361 | TITVGGSTNYADSAKG | 432 | RFTISRDNAKNTVYLQMSSLKPEDTAVYYCNA | 503 | VATVTDYTGTYSDGF | 574 | WGQGTQVTVSS |
| 08H01 | 149 | EVQLVESGGGLVQAGGSLRLSCGASGGTFS | 220 | SYATG | 291 | WFRQAPGKEREFVA | 362 | VLRWSDSHTAYADSVEG | 433 | RFTISRDGAKNTVYLQMSSLKPEDTAIYYCTT | 504 | GTRPGEWHY | 575 | WGQGTQVTVSS |
| 12A09 | 150 | EVQLVESGGGLVQPGGSLRLSCAASGFTFS | 221 | SYRMA | 292 | WVRQAPGKGLEWVS | 363 | STSTGGEMTNYADSVKG | 434 | RFTISRDNAKNTLHLQMNSLKPEDTALYYCAA | 505 | GTSAGHWST | 576 | GGQGTQVTVSS |
| 16A04 | 151 | EVQLVESGGGLVQAGGSLRLSCAASGRTFS | 222 | SYVVG | 293 | WFRQAPGKEREFIG | 364 | AISGSGDSIYYAVSEKD | 435 | RFTISRDNGKNTLYLQMSSLKAEDTAVYYCTA | 506 | DQEFGYLRFGRSEY | 577 | WGQGTQVTVSS |
| 24B08 | 152 | EVQLVESGGGLVQAGGSLRLSCAVSGGTFS | 223 | TYKMG | 294 | WFRQAPGKEREIVA | 365 | RISTNGPTAYAEFVKG | 436 | RFTVSRENTKNTVYLQMNSLNIEDTAVYYCAA | 507 | GYDSLFAGYDY | 578 | WGQGTQVTVSS |
| 01A01 | 153 | EVQLVESGGGLVQAGGSLRLSCAASGFTFD | 224 | DYDIG | 295 | WFRQAPGKEREGVS | 366 | CFTSSDGRTFYADSVKG | 437 | RFTVSADNAKNTVYLQMNSLEPEDTAVYFCAA | 508 | VNTFDESAYAAFACYDVVR | 579 | WGQGTQVTVSS |
| 09B09 | 154 | EMQLVESGGGLVQPGGSLRLSCAASGFTFS | 225 | SYWMY | 296 | WARQAPGKGLEWIS | 367 | ALAPGGDDEYYADSVNG | 438 | RFTISRDNAENSLYLQMNSLKSEDTAVYYCAK | 509 | DHNVGYRTGEYDY | 580 | GGQGTQVTVSS |
| 09E11 | 155 | EVQLVESGGGLVQPGGSLRLSCAASGFTFS | 226 | SYWMY | 297 | WVRQAPGKGLEWIS | 368 | ALAPGGDNRYYADSVNG | 439 | RFTISRDNAENSLYLQMNSLKSEDTAVYYCAK | 510 | DHNVGYRTGEYDY | 581 | GGQGTQVTVSS |
| 10A04 | 156 | EVQLVESGGGLVQPGGSLRLSCAASGFTFS | 227 | SYWMY | 298 | WVRQAPGKGLEWIS | 369 | ALAPGGGNRYYAESVNG | 440 | RFTISRDNAKNSLYLQMNSLKSEDTAVYYCAK | 511 | DHNVGYRTGEYDY | 582 | GGQGTQVTVSS |
| 10A05 | 157 | EVQLVESGGGLVQPGGSLRLSCAASGFTFS | 228 | NYWMY | 299 | WVRQAPGKGLEWIS | 370 | ALAPGGDNRYYADSVNG | 441 | RFTISRDNAENSLYLQMNSLKSEDTAVYYCAK | 512 | DHNVGYRTGEYDY | 583 | GGQGTQVTVSS |
| 10D11 | 158 | EVQLVESGGGLVQAGGSLRLSCAASGFTFS | 229 | SYWMY | 300 | WVRQAPGKGLEWIS | 371 | ALAPGGEHRYYADSVNG | 442 | RFTISRDNAKNSLYLQMNSLKSEDTAVYYCAK | 513 | DHNVGYRTGEYDY | 584 | GGQGTQVTVSS |
| 10F02 | 159 | EVQLVESGGGLVQPGGSLRLSCAASGFTFS | 230 | SYWMY | 301 | WVRQAPGKGLEWIS | 372 | ALAPGGGNAYYADSVNG | 443 | RFTISRDNAENLLYLQMNSLKSEDTAVYYCAK | 514 | DHNVGYRTGEYDY | 585 | GGQGTQVTVSS |
| 11A02 | 160 | EVQLVESGGGLVQAGGSLRLSCAASGVIFR | 231 | LNAMG | 302 | WYRAAPGKQRELVA | 373 | IIINGGSTNYADSVKG | 444 | RFTISRDSAKNAVYLQMNSLKPEDTAVYYCYY | 515 | NIPGDVY | 586 | WGQGTQVTVSS |
| 11A07 | 161 | EVQLVESGGGLVQAGGSLRLSCAAPGVIFR | 232 | LNAMG | 303 | WYRAAPGKQRELVA | 374 | IIANGGSTNYADSVKG | 445 | RFTISRDSAKNAVYLQMNSLKPEDTAVYYCYY | 516 | NIPGDVY | 587 | WGQGTRVTVSS |
| 11C08 | 162 | EVQLVESGGGLVQAGGSLRLSCAASGVIFR | 233 | LNAMG | 304 | WYRAAPGKQRELVA | 375 | IIVNGGSTNYADSVKG | 446 | RFTISRDSAKNAVYLQMNSLKPEDTAVYYCYY | 517 | NIPGDVY | 588 | WGQGTQVTVSS |
| 11C09 | 163 | EVQLVESGGGLVQAGGSLRLSCAASGVIFR | 234 | LNAMG | 305 | WYRAAPGKQRELVA | 376 | IIVNGGSTNYADSVKG | 447 | RFTISRDNAKNAVYLQMDSLKPEDTAVYYCYY | 518 | NIPGDVY | 589 | WGQGTQVTVSS |

TABLE B-1-continued

Preferred combinations of CDR sequences, preferred combinations of framework sequences, and preferred combinations of framework and CDR sequences. ("ID" refers to the SEQ ID NO as used herein)

| | ID | FR1 | ID | CDR1 | ID | FR2 | ID | CDR2 | ID | FR3 | ID | CDR3 | ID | FR4 |
|---|---|---|---|---|---|---|---|---|---|---|---|---|---|---|
| 12H11 | 164 | EVQLVESGGGLVQPGGSLRLSCAASGVIFR | 235 | LNAMG | 306 | WYRAAPGKQRELVA | 377 | IIVNGGSTNYADSVKG | 448 | RFTISRDNAKNAVYLQMNSLKPEDTAVYYCYY | 519 | NIPGDVY | 590 | WGQGTQVTVSS |
| 13B03 | 165 | EVQLVESGGGSVQAGDSLRLSCAASGRANS | 336 | INWFG | 307 | WFRQTPGKEREFVA | 378 | GIRWSDAYTEYANSVKG | 449 | RFTISRDNAKNTVDLQMDSLKPEDTAVYYCVL | 520 | DLSTVRY | 591 | WGQGTQVTVSS |
| 13D05 | 166 | EVQLVESGGGSVQAGDSLRLSCAASGRANS | 237 | INWFG | 308 | WFRQTPGKEREFVA | 379 | GIRWTDAYTEYAASVKG | 450 | RFTISRDNAKNTVGLQMDSLKPEDTAVYYCVL | 521 | DLSTVRY | 592 | WGQGSQVTVSS |
| 13E02 | 167 | EVQLVESGGGLVQAGGSLRLSCAASGRTYD | 238 | AMG | 309 | WLRQAPGKEREFVA | 380 | AISGSGDDTYYADSVKG | 451 | RFTISKDNAGITMYLQMNSLKPEDTAVYYCAT | 522 | RRGLYYVWDSNDYEN | 593 | WGQGTQVTVSS |
| 01D08 | 168 | EVQLVESGGGLVQAGGSLRLSCAASGRTYY | 239 | AMG | 310 | WLRQAPGKEREFVA | 381 | AISGSGDDTYYADSVKG | 452 | RFTISKDNAGITMYLEMNSLKPEDTAVYYCAT | 523 | RRGRYYVWDSNDYEN | 594 | WGQGTQVTVSS |
| 13E07 | 169 | EVQLVESGGGLVQAGGSLRLSCAASGRTYY | 240 | AMG | 311 | WLRQAPGKEREFVA | 382 | AISGSGDDTYYADSVKG | 453 | RFTISKDNAGITMYLQMNSLKPEDTAVYYCAT | 524 | RRGLYYVWDSNDYEN | 595 | WGQGTQVTVSS |
| 13G06 | 170 | EVQLVESGGGLVQAGGSLRLSCAASGRTYH | 241 | AMG | 312 | WLRQAPGKEREFVA | 383 | AVSGSGDDTYYADSVKG | 454 | RFTISKDNAGITMYLQMNSLKPEDTAVYYCAT | 525 | RRGLYYVWDSNDYEN | 596 | WGQGTQVTVSS |
| 13H05 | 171 | EVQLVESGGGLVQAGGSLRLSCAASGRTYD | 242 | AMG | 313 | WFRQAPGKEREFVA | 384 | AISGSGEDTYYADSVKG | 455 | RFTCSKDNAKDTMYLQMNSLKPEDTAVYYCAT | 526 | RRGLYFITDSNDYEN | 597 | WGQGTQVTVSS |
| 13E05 | 172 | EVQLVESGGGKVQAGDSLTLSCVASGGTFS | 243 | NYAA | 314 | WFRQAPGKDRRELV | 385 | VSIFRTGSITYTADSVKG | 456 | RFTASRVNTKNTVYLQMNSLKPEDTAVYYCAS | 527 | AYNPGVGYDY | 598 | WGQGTQVTVSS |
| 17B03 | 173 | EVQLVESGGGLVQAGGSLRLSCEASGGTFS | 244 | NYAA | 315 | WFRQGPGKGRELW | 386 | SIFRSGTITYTADSVKG | 457 | RFTASRVNTKNTVYLQMNSLKPEDTGIYYCAS | 528 | AYNPGIGYDY | 599 | WGQGTQVTVSS |
| 17D08 | 174 | EVQLVESGGGLVQAGDSLTLSCVASGGTFS | 245 | NYAA | 316 | WFRQAPGKDRRELV | 387 | VSIFRTGSITYTADSVKG | 458 | RFTASRVNTKNTVYLQMNSLKPEDTAVYYCAS | 529 | AYNPGVGYDY | 600 | WGQGTQVTVSS |
| 17E05 | 175 | EVQLVESGGGLVQAGDSLRLSCEASGGTFS | 246 | NYAA | 317 | WFRQGPGKGRELW | 388 | SIFRSGTITYTADSVKG | 459 | RFTASRVNTKNTVYLQMNSLKPEDTGIYYCAS | 530 | AYNPGIGYDY | 601 | WGQGTQVTVSS |
| 17G08 | 176 | EVQLVESGGGLVQPGGSLRLSCEASGGTFS | 247 | NYAA | 318 | WFRQGPGKGRELVV | 389 | SIFRSGTITYTADSVKG | 460 | RFTASRVNTKNTVYLQMNSLKPEDTGIYYCAS | 531 | AYNPGIGYDY | 602 | WGQGTQVTVSS |
| 17H04 | 177 | EVQLVESGGGLVQAGDSLRLSCVASGGTFS | 248 | NYAA | 319 | WFRQAPGKGRELIL | 390 | SIFRSGSITYTADSVKG | 461 | RFTGSRVNTKNTAYLQMNNLKPEDTAVYYCAS | 532 | AYNPGIGYDY | 603 | WGQGTQVTVSS |
| 17H07 | 178 | EVQLVESGGGLVQAGDSLTLSCVASGGTFS | 249 | NYAA | 320 | WFRQAPGKDRRELV | 391 | VSIFRTGSTTYTADSVKG | 462 | RFTASRVNTKNTVYLQMNSLKPEDTAVYYCAS | 533 | AYNPGVGYDY | 604 | WGQGTQVTVSS |
| 01C09 | 179 | EVQLVKSGGGLVQAGGSLKLSCAASGRTFT | 250 | TYPMG | 321 | WFRQAPGKEREFVG | 392 | AISMSGEDTIYATSVKG | 463 | RFTISRDDARNTVTLHMTSLKPEDTAVYYCAA | 534 | RTSYNGRYDYIDDYSY | 605 | WGQGTQVTVSS |
| 01F10 | 180 | EVQLVESGGGLVQAGGSLRLSCAASGRTFT | 251 | TYPMG | 322 | WFRQAPGKEREFVA | 393 | AISMSGEDAAYATSVKG | 464 | RFTISRDNARNTVYLHMTTLKPEDTAVYYCAA | 535 | RTSYNGIYDYIDDYSY | 606 | WGQGTQVTVSS |
| 02D02 | 181 | EVQLVESGGGLVQAGGSLKLSCARSGRTFT | 252 | TYPMG | 323 | WFRQAPGKEREFVA | 394 | AISMSGDDTAYATFVKG | 465 | RFTIVRDDDKNTVYLHMTSLKPEDTAVYYCAA | 536 | RTSYSGTYDYIDDYSY | 607 | WGQGTQVTVSS |

TABLE B-1-continued

Preferred combinations of CDR sequences, preferred combinations of framework sequences, and preferred combinations of framework and CDR sequences. ("ID" refers to the SEQ ID NO as used herein)

| | ID | FR1 | ID | CDR1 | ID | FR2 | ID | CDR2 | ID | FR3 | ID | CDR3 | ID | FR4 |
|---|---|---|---|---|---|---|---|---|---|---|---|---|---|---|
| 13A08 | 182 | EVQLVESRGRLVQAGGSLRLSCAASGRTFT | 253 | SYPMG | 324 | WFRQAPGKEREFVA | 395 | AISMSGDDAAYADFVRG | 466 | RFTISRDDARNTVYLHMTSLKPEDTAVYYCAA | 537 | RTSYDGTYDYIDDYSY | 608 | WGQGTQVTVSS |
| 13B05 | 183 | EVQLVESGGRLVQAGGSLRLSCAASGRTFT | 254 | SYPMG | 325 | WFRQAPGKEREFVA | 396 | AISMSGDDTAYTDFVRG | 467 | RFTISRDDARNTVYLHMTSLKPEDTAVYYCAA | 538 | RTSYDGTYDYIDDYSY | 609 | WGQGTQVTVSS |
| 13C06 | 184 | EVQLVESGGRLVQAGGSLRLSCAASGRTFT | 255 | SYPMG | 326 | WFRQAPGKEREFVA | 397 | AISMSGDDAAYADFVRG | 468 | RFTISRDDARNTVYLHMTSLKPEDTAVYYCAA | 539 | RTSYDGTYDYIDDYSY | 610 | WGQGTQVTVSS |
| 13E01 | 185 | EVQLVESEGGLVQAGGSLRLSCARSGHAFT | 256 | SYPMG | 327 | WFRQAPGKEREFVA | 398 | AISMSGDDTIYRDFVKG | 469 | RFTISRDNARNTVYLHMTSLKPEDTAVYYCAA | 540 | RTSYDGRYDYIDDYSY | 611 | WGQGTQVTVSS |
| 13E03 | 186 | EVQLVESGGGLVQAGGSLRLSCAASGRTFT | 257 | TYPMG | 328 | WFRQAPGKEREFVA | 399 | AISMSGDDTAYATFVKG | 470 | RFTISRDSARNTVYLHMTRLKPEDTAVYSCAA | 541 | RTSYDGRYDYIDDYSD | 612 | WGQGTQVTVSS |
| 13E08 | 187 | EVQLVESRGGLVQAGGSLRLSCAGSGRTLY | 258 | SYPMG | 329 | WFRQAPGKEREFVA | 400 | AISMSGDDTAVATFVKG | 471 | RFTISRDNARNTVYLHMTSLKPEDTAVYHCAA | 542 | RTSYSGRYDYIDDYSY | 613 | WGQGTQVTVSS |
| 13G04 | 188 | EVQLVESGGGLVQAGGSLRLSCAASGRTLY | 259 | SYPMG | 330 | WFRQAPGKEREFVA | 401 | AISMSGDDTAVATFVKG | 472 | RFTISRDNARNTVYLHMSSLKPEDTAVYHCAA | 543 | RTSYSGRYDYIDDYSY | 614 | WGQGTQVTVSS |
| 13G05 | 189 | EVQLVESGGGLVQAGGSLELSCARSGRTFT | 260 | TYPMG | 331 | WFRQAPGKEREFVA | 402 | AISMSGDDTAYATFVKG | 473 | RFTFSRDDDKNTVYLHMTSLKPEDTAVYYCAA | 544 | RTSYSGMYDYIHDYSY | 615 | WGQGTQVTVSS |
| 13G08 | 190 | EVQLVESGGGLVQAGGSLRLSCAASGRTFF | 261 | SYPMG | 332 | WFRQAPGKEREFVA | 403 | AISMSGDDSAYRDFVKG | 474 | RFTISRDNARDTVYLHMTSLKPEDTAIYYCAA | 545 | RTSYNGRYDYIDDYSY | 616 | WGQGTQVTVSS |
| 13H03 | 191 | EVQLVESGGGLVQAGGSLRLSCAASGRTFT | 262 | TYPMG | 333 | WFRQAPGKEREFVA | 404 | AISMSGDDTAYATFVKG | 475 | RFTISRDNARNTVYLHMTRLKPEDTAVYSCAA | 546 | RTSYDGRYDYIDDYSD | 617 | WGQGTQVTVSS |
| 17C01 | 192 | EVQLVESGGRLVQAGGSLRLPCAASGRTFT | 263 | SYPMG | 334 | WFRQAPGKEREFVA | 405 | AISMSGDDAAYADFVRG | 476 | RFTISRDDARNTVYLHMTSLKPEDTAVYYCAA | 547 | RTSYDGTYDYIDDYSY | 618 | WGQGTQVTVSS |
| 15A08 | 193 | EVQLVESGGGLVQPGGSLRLSCAASGFTLD | 264 | YYAIG | 335 | WFRQAPGKEREGVS | 406 | CVSSSDGRTAYADSVKG | 477 | RFTISRDNAKNTVYLQMNSLKPEDTAVYYCAT | 548 | VMEYGLGCTTDVLDA | 619 | WGQGTLVTVSS |
| 13G02 | 194 | EVQLVESRGGLVQAGGSLRLSCAASGGTFS | 265 | VFAMR | 336 | WFRQAPGKEREFVA | 407 | GISWTGGTTYYADSVKG | 478 | RFTMSADNAKNTVYLQMNSLKPEDTAVYYCAV | 549 | DVGGGSDRY | 620 | LGQGTQVTVSS |
| 17E02 | 195 | EVQLVESRGGLVQAGGSLRLSCAASGGTFS | 266 | VFAMR | 337 | WFRQAPGKEREFVA | 408 | GISWTGGTTYYADSVKG | 479 | RFTMSADNAKNTVYLQMNSLKPEDTAVYYCAV | 550 | DVGGGSDRY | 621 | LGQGTQVTVSS |
| 18B05 | 196 | EVQLVKSGGGLVQPGGSLRLSCAASGGTFS | 267 | LFAMG | 338 | WFREAPGKEREFVA | 409 | AIRWSDGSSYYADSVKG | 480 | RFTISRDNAKNAVHLQSNSLKSEDTAVYYCYA | 551 | DVQGGLHRY | 622 | WGQGTQVTVSS |

Thus, in the Nanobodies (or ISV's) of the invention, at least one of the CDR1, CDR2 and CDR3 sequences present is suitably chosen from the group consisting of the CDR1, CDR2 and CDR3 sequences, respectively, listed in Table B-1; or from the group of CDR1, CDR2 and CDR3 sequences, respectively, that have at least 80%, preferably at least 90%, more preferably at least 95%, even more preferably at least 99% "sequence identity" (as defined herein) with at least one of the CDR1, CDR2 and CDR3 sequences, respectively, listed in Table B-1; and/or from the group consisting of the CDR1, CDR2 and CDR3 sequences, respectively, that have 3, 2 or only 1 "amino acid difference(s)" (as defined herein) with at least one of the CDR1, CDR2 and CDR3 sequences, respectively, listed in Table B-1.

In this context, by "suitably chosen" is meant that, as applicable, a CDR1 sequence is chosen from suitable CDR1 sequences (i.e. as defined herein), a CDR2 sequence is chosen from suitable CDR2 sequences (i.e. as defined herein), and a CDR3 sequence is chosen from suitable CDR3 sequences (i.e. as defined herein), respectively. More in particular, the CDR sequences are preferably chosen such that the Nanobodies (or ISV's) of the invention bind to any of IL-17A, IL-17F and/or IL-17A/F including combinations thereof with an affinity (suitably measured and/or expressed as a $K_D$-value (actual or apparent), a $K_A$-value (actual or apparent), a $k_{on}$-rate and/or a $k_{off}$-rate, or alternatively as an IC50 value, as further described herein) that is as defined herein.

In particular, in the Nanobodies (or ISV's) of the invention, at least the CDR3 sequence present is suitably chosen from the group consisting of the CDR3 sequences listed in Table B-1 or from the group of CDR3 sequences that have at least 80%, preferably at least 90%, more preferably at least 95%, even more preferably at least 99% sequence identity with at least one of the CDR3 sequences listed in Table B-1; and/or from the group consisting of the CDR3 sequences that have 3, 2 or only 1 amino acid difference(s) with at least one of the CDR3 sequences listed in Table B-1.

Preferably, in the Nanobodies (or ISV's) of the invention, at least two of the CDR1, CDR2 and CDR3 sequences present are suitably chosen from the group consisting of the CDR1, CDR2 and CDR3 sequences, respectively, listed in Table B-1 or from the group consisting of CDR1, CDR2 and CDR3 sequences, respectively, that have at least 80%, preferably at least 90%, more preferably at least 95%, even more preferably at least 99% sequence identity with at least one of the CDR1, CDR2 and CDR3 sequences, respectively, listed in Table B-1; and/or from the group consisting of the CDR1, CDR2 and CDR3 sequences, respectively, that have 3, 2 or only 1 "amino acid difference(s)" with at least one of the CDR1, CDR2 and CDR3 sequences, respectively, listed in Table B-1.

In particular, in the Nanobodies (or ISV's) of the invention, at least the CDR3 sequence present is suitably chosen from the group consisting of the CDR3 sequences listed in Table B-1 or from the group of CDR3 sequences that have at least 80%, preferably at least 90%, more preferably at least 95%, even more preferably at least 99% sequence identity with at least one of the CDR3 sequences listed in Table B-1, respectively; and at least one of the CDR1 and CDR2 sequences present is suitably chosen from the group consisting of the CDR1 and CDR2 sequences, respectively, listed in Table B-1 or from the group of CDR1 and CDR2 sequences, respectively, that have at least 80%, preferably at least 90%, more preferably at least 95%, even more preferably at least 99% sequence identity with at least one of the CDR1 and CDR2 sequences, respectively, listed in Table B-1; and/or from the group consisting of the CDR1 and CDR2 sequences, respectively, that have 3, 2 or only 1 amino acid difference(s) with at least one of the CDR1 and CDR2 sequences, respectively, listed in Table B-1.

Most preferably, in the Nanobodies (or ISV's) of the invention, all three CDR1, CDR2 and CDR3 sequences present are suitably chosen from the group consisting of the CDR1, CDR2 and CDR3 sequences, respectively, listed in Table B-1 or from the group of CDR1, CDR2 and CDR3 sequences, respectively, that have at least 80%, preferably at least 90%, more preferably at least 95%, even more preferably at least 99% sequence identity with at least one of the CDR1, CDR2 and CDR3 sequences, respectively, listed in Table B-1; and/or from the group consisting of the CDR1, CDR2 and CDR3 sequences, respectively, that have 3, 2 or only 1 amino acid difference(s) with at least one of the CDR1, CDR2 and CDR3 sequences, respectively, listed in Table B-1.

Even more preferably, in the Nanobodies (or ISV's) of the invention, at least one of the CDR1, CDR2 and CDR3 sequences present is suitably chosen from the group consisting of the CDR1, CDR2 and CDR3 sequences, respectively, listed in Table B-1. Preferably, in this aspect, at least one or preferably both of the other two CDR sequences present are suitably chosen from CDR sequences that have at least 80%, preferably at least 90%, more preferably at least 95%, even more preferably at least 99% sequence identity with at least one of the corresponding CDR sequences, respectively, listed in Table B-1; and/or from the group consisting of the CDR sequences that have 3, 2 or only 1 amino acid difference(s) with at least one of the corresponding sequences, respectively, listed in Table B-1.

In particular, in the Nanobodies (or ISV's) of the invention, at least the CDR3 sequence present is suitably chosen from the group consisting of the CDR3 listed in Table B-1. Preferably, in this aspect, at least one and preferably both of the CDR1 and CDR2 sequences present are suitably chosen from the groups of CDR1 and CDR2 sequences, respectively, that have at least 80%, preferably at least 90%, more preferably at least 95%, even more preferably at least 99% sequence identity with the CDR1 and CDR2 sequences, respectively, listed in Table B-1; and/or from the group consisting of the CDR1 and CDR2 sequences, respectively, that have 3, 2 or only 1 amino acid difference(s) with at least one of the CDR1 and CDR2 sequences, respectively, listed in Table B-1.

Even more preferably, in the Nanobodies (or ISV's) of the invention, at least two of the CDR1, CDR2 and CDR3 sequences present are suitably chosen from the group consisting of the CDR1, CDR2 and CDR3 sequences, respectively, listed in Table B-1. Preferably, in this aspect, the remaining CDR sequence present is suitably chosen from the group of CDR sequences that have at least 80%, preferably at least 90%, more preferably at least 95%, even more preferably at least 99% sequence identity with at least one of the corresponding CDR sequences listed in Table B-1; and/or from the group consisting of CDR sequences that have 3, 2 or only 1 amino acid difference(s) with at least one of the corresponding sequences listed in Table B-1.

In particular, in the Nanobodies (or ISV's) of the invention, at least the CDR3 sequence is suitably chosen from the group consisting of the CDR3 sequences listed in Table B-1, and either the CDR1 sequence or the CDR2 sequence is suitably chosen from the group consisting of the CDR1 and CDR2 sequences, respectively, listed in Table B-1. Preferably, in this aspect, the remaining CDR sequence present is suitably chosen from the group of CDR sequences that have at least 80%, preferably at least 90%, more preferably at least 95%, even more preferably at least 99% sequence identity with at least one of the corresponding CDR sequences listed in Table B-1; and/or from the group consisting of CDR sequences that have 3, 2 or only 1 amino acid difference(s) with the corresponding CDR sequences listed in Table B-1.

Even more preferably, in the Nanobodies (or ISV's) of the invention, each of the CDR1, CDR2 and CDR3 sequences present are suitably chosen from the group consisting of the CDR1, CDR2 and CDR3 sequences, respectively, listed in Table B-1.

Also, generally, the combinations of CDR's listed in Table B-1 (i.e. those mentioned on the same line, e.g. row, in Table B-1) are preferred. Thus, it is generally preferred that, when a CDR in a Nanobody (or ISV) of the invention is a CDR sequence mentioned in Table B-1 or is suitably chosen from the group of CDR sequences that have at least 80%, preferably at least 90%, more preferably at least 95%, even more preferably at least 99% sequence identity with a CDR sequence listed in Table B-1; and/or from the group consisting of CDR sequences that have 3, 2 or only 1 amino acid difference(s) with a CDR sequence listed in Table B-1, that at least one and preferably both of the other CDR's are suitably chosen from the CDR sequences that belong to the same combination in Table B-1 (i.e. mentioned on the same line, e.g. row, in Table B-1) or are suitably chosen from the group of CDR sequences that have at least 80%, preferably at least 90%, more preferably at least 95%, even more preferably at least 99% sequence identity with the CDR sequence(s) belonging to the same combination and/or from the group consisting of CDR sequences that have 3, 2 or only 1 amino acid difference(s) with the CDR sequence(s) belonging to the same combination. The other preferences indicated in the above paragraphs also apply to the combinations of CDR's mentioned in Table B-1.

Thus, by means of non-limiting examples, a Nanobody (or ISV) of the invention can for example comprise a CDR1 sequence that has more than 80% sequence identity with one of the CDR1 sequences mentioned in Table B-1, a CDR2 sequence that has 3, 2 or 1 amino acid difference with one of the CDR2 sequences mentioned in Table B-1 (but belonging to a different combination, e.g. from at least one different row), and a CDR3 sequence.

Some preferred Nanobodies (or ISV's) of the invention may for example comprise: (1) a CDR1 sequence that has more than 80% sequence identity with one of the CDR1 sequences mentioned in Table B-1; a CDR2 sequence that has 3, 2 or 1 amino acid difference with one of the CDR2 sequences mentioned in Table B-1 (but belonging to a different combination, e.g. from at least one different row); and a CDR3 sequence that has more than 80% sequence identity with one of the CDR3 sequences mentioned in Table B-1 (but belonging to a different combination); or (2) a CDR1 sequence that has more than 80% sequence identity with one of the CDR1 sequences mentioned in Table B-1; a CDR2 sequence, and one of the CDR3 sequences listed in Table B-1; or (3) a CDR1 sequence; a CDR2 sequence that has more than 80% sequence identity with one of the CDR2 sequence listed in Table B-1; and a CDR3 sequence that has 3, 2 or 1 amino acid differences with the CDR3 sequence mentioned in Table B-1 that belongs to the same combination as the CDR2 sequence.

In this context, the person skilled in the art will appreciate that the "same combination" refers to a combination of CDR1, CDR2 and CDR3 which are depicted on the same row (or line) in Table B-1, and that a "different combination" refers to a combination of CDR1, CDR2 and CDR3, of which at least one CDR is not depicted on the same row (or line) in Table B-1 as at least one other CDR.

Some particularly preferred Nanobodies (or ISV's) of the invention may for example comprise: (1) a CDR1 sequence that has more than 80% sequence identity with one of the CDR1 sequences mentioned in Table B-1; a CDR2 sequence that has 3, 2 or 1 amino acid difference with the CDR2 sequence mentioned in Table B-1 that belongs to the same combination; and a CDR3 sequence that has more than 80% sequence identity with the CDR3 sequence mentioned in Table B-1 that belongs to the same combination; (2) a CDR1 sequence; a CDR2 listed in Table B-1 and a CDR3 sequence listed in Table B-1 (in which the CDR2 sequence and CDR3 sequence may belong to different combinations).

Some even more preferred Nanobodies (or ISV's) of the invention may for example comprise: (1) a CDR1 sequence that has more than 80% sequence identity with one of the CDR1 sequences mentioned in Table B-1; the CDR2 sequence listed in Table B-1 that belongs to the same combination; and a CDR3 sequence mentioned in Table B-1 that belongs to a different combination; or (2) a CDR1 sequence mentioned in Table B-1; a CDR2 sequence that has 3, 2 or 1 amino acid differences with the CDR2 sequence mentioned in Table B-1 that belongs to the same combination; and a CDR3 sequence that has more than 80% sequence identity with the CDR3 sequence listed in Table B-1 that belongs to the same or a different combination.

Particularly preferred Nanobodies (or ISV's) of the invention may for example comprise a CDR1 sequence mentioned in Table B-1, a CDR2 sequence that has more than 80% sequence identity with the CDR2 sequence mentioned in Table B-1 that belongs to the same combination; and the CDR3 sequence mentioned in Table B-1 that belongs to the same combination.

In the most preferred Nanobodies (or ISV's) of the invention, the CDR1, CDR2 and CDR3 sequences present are suitably chosen from one of the combinations of CDR1, CDR2 and CDR3 sequences, respectively, listed in Table B-1.

According to another preferred, but non-limiting aspect of the invention (a) CDR1 has a length of between 1 and 12 amino acid residues, and usually between 2 and 9 amino acid residues, such as 5, 6 or 7 amino acid residues; and/or (b) CDR2 has a length of between 13 and 24 amino acid residues, and usually between 15 and 21 amino acid residues, such as 16 and 17 amino acid residues; and/or (c) CDR3 has a length of between 2 and 35 amino acid residues, and usually between 3 and 30 amino acid residues, such as between 6 and 23 amino acid residues.

In another preferred, but non-limiting aspect, the invention relates to a Nanobody (or ISV) in which the CDR sequences (as defined herein) have more than 80%, preferably more than 90%, more preferably more than 95%, such as 99% or more sequence identity (as defined herein) with the CDR sequences of at least one of the amino acid sequences of SEQ ID NOs: 623 to 693 (see Table A-1).

Generally, Nanobodies (or ISV's) with the above CDR sequences may be as further described herein, and preferably have framework sequences that are also as further described herein. Thus, for example and as mentioned herein, such Nanobodies (or ISV's) may be naturally occurring Nanobodies (or ISV's) (from any suitable species), naturally occurring $V_{HH}$ sequences (i.e. from a suitable species of Camelid) or synthetic or semi-synthetic amino acid sequences or Nanobodies (or ISV's), including but not limited to partially humanized Nanobodies (or ISV's) or $V_{HH}$ sequences, fully humanized Nanobodies (or ISV's) or $V_{HH}$ sequences, camelized heavy chain variable domain sequences, as well as Nanobodies (or ISV's) that have been obtained by the techniques mentioned herein.

Thus, in one specific, but non-limiting aspect, the invention relates to a humanized Nanobody (or ISV), which consists of 4 framework regions (FR1 to FR4 respectively) and 3 complementarity determining regions (CDR1 to CDR3 respectively), in which CDR1 to CDR3 are as defined herein and in which said humanized Nanobody (or ISV) comprises at least one humanizing substitution (as defined herein), and in particular at least one humanizing substitution in at least one of its framework sequences (as defined herein).

In another preferred, but non-limiting aspect, the invention relates to a Nanobody (or ISV) in which the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NOs: 623 to 693 (see Table A-1). This degree of amino acid identity can for example be determined by determining the degree of amino acid identity (in a manner described herein) between said Nanobody (or ISV) and one or more of the sequences of SEQ ID NOs: 623 to 693 (see Table A-1), in which the amino acid residues that form the framework regions are disregarded. Such Nanobodies (or ISV's) can be as further described herein.

In another preferred, but non-limiting aspect, the invention relates to a Nanobody (or ISV) with an amino acid sequence that is chosen from the group consisting of SEQ ID NOs: 623 to 693 (see Table A-1) or from the group consisting of from amino acid sequences that have more than 80%, preferably more than 90%, more preferably more than 95%, such as 99% or more sequence identity (as defined herein) with at least one of the amino acid sequences of SEQ ID NOs: 623 to 693 (see Table A-1).

It will be clear to the skilled person that the Nanobodies (or ISV's) that are mentioned herein as "preferred" (or "more preferred", "even more preferred", etc.) are also preferred (or more preferred, or even more preferred, etc.) for use in the polypeptides described herein. Thus, polypeptides that comprise or essentially consist of one or more "preferred" Nanobodies (or ISV's) of the invention will generally be preferred, and polypeptides that comprise or essentially consist of one or more "more preferred" Nanobodies (or ISV's) of the invention will generally be more preferred, etc.

Generally, proteins or polypeptides that comprise or essentially consist of a single Nanobody (or ISV) (such as a single Nanobody (or ISV) of the invention) will be referred to herein as "monovalent" proteins or polypeptides or as "monovalent constructs". Proteins and polypeptides that comprise or essentially consist of two or more Nanobodies (or ISV's) (such as at least two Nanobodies (or ISV's) of the invention or at least one Nanobody (or ISV) of the invention and at least one other Nanobody (or ISV)) will be referred to herein as "multivalent" proteins or polypeptides or as "multivalent constructs", and these may provide certain advantages compared to the corresponding monovalent Nanobodies (or ISV's) of the invention. Some non-limiting examples of such multivalent constructs will become clear from the further description herein.

According to one specific, but non-limiting aspect, a polypeptide of the invention comprises or essentially consists of at least two Nanobodies (or ISV's) of the invention, such as two or three Nanobodies (or ISV's) of the invention. As further described herein, such multivalent constructs can provide certain advantages compared to a protein or polypeptide comprising or essentially consisting of a single Nanobody (or ISV) of the invention, such as a much improved avidity for any of IL-17A, IL-17F and/or IL-17A/F including combinations thereof. Such multivalent constructs will be clear to the skilled person based on the disclosure herein.

According to another specific, but non-limiting aspect, a polypeptide of the invention comprises or essentially consists of at least one Nanobody (or ISV) of the invention and at least one other binding unit (i.e. directed against another epitope, antigen, target, protein or polypeptide), which is preferably also a Nanobody (or ISV). Such proteins or polypeptides are also referred to herein as "multispecific" proteins or polypeptides or as 'multispecific constructs", and these may provide certain advantages compared to the corresponding monovalent Nanobodies (or ISV's) of the invention (as will become clear from the further discussion herein of some preferred, but-nonlimiting multispecific constructs). Such multispecific constructs will be clear to the skilled person based on the disclosure herein.

According to yet another specific, but non-limiting aspect, a polypeptide of the invention comprises or essentially consists of at least one Nanobody (or ISV) of the invention, optionally one or more further Nanobodies (or ISV's), and at least one other amino acid sequence (such as a protein or polypeptide) that confers at least one desired property to the Nanobody (or ISV) of the invention and/or to the resulting fusion protein. Again, such fusion proteins may provide certain advantages compared to the corresponding monovalent Nanobodies (or ISV's) of the invention. Some non-limiting examples of such amino acid sequences and of such fusion constructs will become clear from the further description herein.

It is also possible to combine two or more of the above aspects, for example to provide a trivalent bispecific construct comprising two Nanobodies (or ISV's) of the invention and one other Nanobody (or ISV), and optionally one or more other amino acid sequences. Further non-limiting examples of such constructs, as well as some constructs that are particularly preferred within the context of the present invention, will become clear from the further description herein.

In the above constructs, the one or more Nanobodies (or ISV's) and/or other amino acid sequences may be directly linked to each other and/or suitably linked to each other via one or more linker sequences. Some suitable but non-limiting examples of such linkers will become clear from the further description herein.

In one specific aspect of the invention, a Nanobody (or ISV) of the invention or a compound, construct or polypeptide of the invention comprising at least one Nanobody (or ISV) of the invention may have an increased half-life, compared to the corresponding amino acid sequence of the invention. Some preferred, but non-limiting examples of such Nanobodies (or ISV's), compounds and polypeptides will become clear to the skilled person based on the further disclosure herein, and for example comprise Nanobodies (or ISV's) sequences or polypeptides of the invention that have been chemically modified to increase the half-life thereof (for example, by means of pegylation); amino acid sequences of the invention that comprise at least one additional binding site for binding to a serum protein (such as serum albumin, see for example EP 0 368 684 B1, page 4); or polypeptides of the invention that comprise at least one Nanobody (or ISV) of the invention that is linked to at least one moiety (and in particular at least one amino acid sequence) that increases the half-life of the Nanobody (or ISV) of the invention. Examples of polypeptides of the invention that comprise such half-life extending moieties or amino acid sequences will become clear to the skilled person based on the further disclosure herein; and for example include, without limitation, polypeptides in which the one or more Nanobodies (or ISV's) of the invention are suitable linked to one or more serum proteins or fragments thereof (such as serum albumin or suitable fragments thereof) or to one or more binding units that can bind to serum proteins (such as, for example, Nanobodies (or ISV's) or (single) domain antibodies that can bind to serum proteins such as serum albumin, serum immunoglobulins such as IgG, or transferrine); polypeptides in which a Nanobody (or ISV) of the invention is linked to an Fc portion (such as a human Fc) or a suitable part or fragment thereof; or polypeptides in which the one or more Nanobodies (or ISV's) of the invention are suitable linked to one or more small proteins or peptides that can bind to serum proteins (such as, without limitation, the proteins and peptides described in WO 91/01743, WO 01/45746, WO 02/076489 and to the US provisional application of Ablynx N.V. entitled "Peptides capable of binding to serum proteins" of Ablynx N.V. filed on Dec. 5, 2006 (see also PCT/EP/2007/063348).

Again, as will be clear to the skilled person, such Nanobodies (or ISV's), compounds, constructs or polypeptides may contain one or more additional groups, residues, moieties or binding units, such as one or more further amino acid sequences and in particular one or more additional Nanobodies (or ISV's) (i.e. not directed against any of IL-17A, IL-17F and/or IL-17A/F including combinations thereof), so as to provide a tri- of multispecific Nanobody (or ISV) construct.

Generally, the Nanobodies (or ISV's) of the invention (or compounds, constructs or polypeptides comprising the same) with increased half-life preferably have a half-life that is at least 1.5 times, preferably at least 2 times, such as at least 5 times, for example at least 10 times or more than 20 times, greater than the half-life of the corresponding amino acid sequence of the invention per se. For example, the Nanobodies (or ISV's), compounds, constructs or polypeptides of the invention with increased half-life may have a half-life that is increased with more than 1 hours, preferably more than 2 hours, more preferably more than 6 hours, such as more than 12 hours, or even more than 24, 48 or 72 hours, compared to the corresponding amino acid sequence of the invention per se.

In a preferred, but non-limiting aspect of the invention, such Nanobodies (or ISV's), compound, constructs or polypeptides of the invention exhibit a serum half-life in human of at least about 12 hours, preferably at least 24 hours, more preferably at least 48 hours, even more preferably at least 72 hours or more. For example, compounds or polypeptides of the invention may have a half-life of at least 5 days (such as about 5 to 10 days), preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days).

In another one aspect of the invention, a polypeptide of the invention comprises one or more (such as two or preferably one) Nanobodies (or ISV's) of the invention linked (optionally via one or more suitable linker sequences) to one or more (such as two and preferably one) amino acid sequences that allow the resulting polypeptide of the invention to cross the blood brain barrier. In particular, said one or more amino acid sequences that allow the resulting polypeptides of the invention to cross the blood brain barrier may be one or more (such as two and preferably one) Nanobodies (or ISV's), such as the Nanobodies (or ISV's) described in WO 02/057445, of which FC44 (SEQ ID NO: 189 of WO 06/040153) and FC5 (SEQ ID NO: 190 of WO 06/040154) are preferred examples.

In particular, polypeptides comprising one or more Nanobodies (or ISV's) of the invention are preferably such that they:

bind to any of IL-17A, IL-17F and/or IL-17A/F including combinations thereof with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);

and/or such that they:

bind to any of IL-17A, IL-17F and/or IL-17A/F including combinations thereof with a $k_{on}$-rate of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-}$, such as between $10^5$ $M^{-1}s^{-1}$ and $10^7$ $M^{-1}s^{-1}$;

and/or such that they:

bind to any of IL-17A, IL-17F and/or IL-17A/F including combinations thereof with a $k_{off}$ rate between 1 $s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}s^{-1}$.

Preferably, a polypeptide that contains only one amino acid sequence of the invention is preferably such that it will bind to any of IL-17A, IL-17F and/or IL-17A/F including combinations thereof with an affinity less than 500 nM, preferably less than 200 nM, more preferably less than 10 nM, more preferably less than 1 nM, such as less than 500 pM. In this respect, it will be clear to the skilled person that a polypeptide that contains two or more Nanobodies (or ISV's) of the invention may bind to any of IL-17A, IL-17F and/or IL-17A/F including combinations thereof with an increased avidity, compared to a polypeptide that contains only one amino acid sequence of the invention.

Some preferred IC50 values for binding of the amino acid sequences or polypeptides of the invention to any of IL-17A, IL-17F and/or IL-17A/F including combinations thereof will become clear from the further description and examples herein.

Another aspect of this invention relates to a nucleic acid that encodes an amino acid sequence of the invention (such as a Nanobody (or ISV) of the invention) or a polypeptide of the invention comprising the same. Again, as generally described herein for the nucleic acids of the invention, such a nucleic acid may be in the form of a genetic construct, as defined herein.

In another aspect, the invention relates to host or host cell that expresses or that is capable of expressing an amino acid sequence (such as a Nanobody (or ISV)) of the invention and/or a polypeptide of the invention comprising the same; and/or that contains a nucleic acid of the invention. Some preferred but non-limiting examples of such hosts or host cells will become clear from the further description herein.

Another aspect of the invention relates to a product or composition containing or comprising at least one amino acid sequence of the invention, at least one polypeptide of the invention and/or at least one nucleic acid of the invention, and optionally one or more further components of such compositions known per se, i.e. depending on the intended use of the composition. Such a product or composition may for example be a pharmaceutical composition (as described herein), a veterinary composition or a product or composition for diagnostic use (as also described herein). Some preferred but non-limiting examples of such products or compositions will become clear from the further description herein.

The invention further relates to methods for preparing or generating the amino acid sequences, compounds, constructs, polypeptides, nucleic acids, host cells, products and compositions described herein. Some preferred but non-limiting examples of such methods will become clear from the further description herein.

The invention further relates to applications and uses of the amino acid sequences, compounds, constructs, polypeptides, nucleic acids, host cells, products and compositions described herein, as well as to methods for the prevention and/or treatment for diseases and disorders associated with any of IL-17A, IL-17F and/or IL-17A/F including combinations thereof. Some preferred but non-limiting applications and uses will become clear from the further description herein.

Other aspects, embodiments, advantages and applications of the invention will also become clear from the further description hereinbelow.

Generally, it should be noted that the term Nanobody (or ISV) as used herein in its broadest sense is not limited to a specific biological source or to a specific method of preparation. For example, as will be discussed in more detail below, the Nanobodies (or ISV's) of the invention can generally be obtained by any of the techniques (1) to (8) mentioned on pages 61 and 62 of WO 08/020,079, or any other suitable technique known per se. One preferred class of Nanobodies (or ISV's) corresponds to the $V_{HH}$ domains of naturally occurring heavy chain antibodies directed against any of IL-17A, IL-17F and/or IL-17A/F including combinations thereof. As further described herein, such $V_{HH}$ sequences can generally be generated or obtained by suitably immunizing a species of Camelid with any of IL-17A, IL-17F and/or IL-17A/F including combinations thereof (i.e. so as to raise an immune response and/or heavy chain antibodies directed against any of IL-17A, IL-17F and/or IL-17A/F including combinations thereof), by obtaining a suitable biological sample from said Camelid (such as a blood sample, serum sample or sample of B-cells), and by generating $V_{HH}$ sequences directed against any of IL-17A, IL-17F and/or IL-17A/F including combinations thereof, starting from said sample, using any suitable technique known per se. Such techniques will be clear to the skilled person and/or are further described herein.

Alternatively, such naturally occurring $V_{HH}$ domains against any of IL-17A, IL-17F and/or IL-17A/F including combinations thereof, can be obtained from naïve libraries of Camelid $V_{HH}$ sequences, for example by screening such a library using any of IL-17A, IL-17F and/or IL-17A/F including combinations thereof, or at least one part, fragment, antigenic determinant or epitope thereof using one or more screening techniques known per se. Such libraries and techniques are for example described in WO 99/37681, WO 01/90190, WO 03/025020 and WO 03/035694. Alternatively, improved synthetic or semi-synthetic libraries derived from naïve $V_{HH}$ libraries may be used, such as $V_{HH}$ libraries obtained from naïve $V_{HH}$ libraries by techniques such as random mutagenesis and/or CDR shuffling, as for example described in WO 00/43507.

Thus, in another aspect, the invention relates to a method for generating Nanobodies (or ISV's), that are directed against any of IL-17A, IL-17F and/or IL-17A/F including combinations thereof. In one aspect, said method at least comprises the steps of:

a) providing a set, collection or library of Nanobody (or ISV) sequences; and
b) screening said set, collection or library of Nanobody (or ISV) sequences for Nanobody (or ISV) sequences that can bind to and/or have affinity for any of IL-17A, IL-17F and/or IL-17A/F including combinations thereof;

and c) isolating the Nanobody (or ISV) or Nanobodies (or ISV's) that can bind to and/or have affinity for any of IL-17A, IL-17F and/or IL-17A/F including combinations thereof.

In such a method, the set, collection or library of Nanobody (or ISV) sequences may be a naïve set, collection or library of Nanobody (or ISV) sequences; a synthetic or semi-synthetic set, collection or library of Nanobody (or ISV) sequences; and/or a set, collection or library of Nanobody (or ISV) sequences that have been subjected to affinity maturation.

In a preferred aspect of this method, the set, collection or library of Nanobody (or ISV) sequences may be an immune set, collection or library of Nanobody (or ISV) sequences, and in particular an immune set, collection or library of $V_{HH}$ sequences, that have been derived from a species of Camelid that has been suitably immunized with any of IL-17A, IL-17F and/or IL-17A/F including combinations thereof or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

In the above methods, the set, collection or library of Nanobody (or ISV) or $V_{HH}$ sequences may be displayed on a phage, phagemid, ribosome or suitable micro-organism (such as yeast), such as to facilitate screening. Suitable methods, techniques and host organisms for displaying and screening (a set, collection or library of) Nanobody (or ISV) sequences will be clear to the person skilled in the art, for example on the basis of the further disclosure herein. Reference is also made to WO 03/054016 and to the review by Hoogenboom in Nature Biotechnology, 23, 9, 1105-1116 (2005).

In another aspect, the method for generating Nanobody (or ISV) sequences comprises at least the steps of:

a) providing a collection or sample of cells derived from a species of Camelid that express immunoglobulin sequences;
b) screening said collection or sample of cells for (i) cells that express an immunoglobulin sequence that can bind to and/or have affinity for any of IL-17A, IL-17F and/or IL-17A/F including combinations thereof; and (ii) cells that express heavy chain antibodies, in which substeps (i) and (ii) can be performed essentially as a single screening step or in any suitable order as two separate screening steps, so as to provide at least one cell that expresses a heavy chain antibody that can bind to and/or has affinity for any of IL-17A, IL-17F and/or IL-17A/F including combinations thereof;

and c) either (i) isolating from said cell the $V_{HH}$ sequence present in said heavy chain antibody; or (ii) isolating from said cell a nucleic acid sequence that encodes the $V_{HH}$ sequence present in said heavy chain antibody, followed by expressing said $V_{HH}$ domain.

In the method according to this aspect, the collection or sample of cells may for example be a collection or sample of B-cells. Also, in this method, the sample of cells may be derived from a Camelid that has been suitably immunized with any of IL-17A, IL-17F and/or IL-17A/F including combinations thereof or a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

The above method may be performed in any suitable manner, as will be clear to the skilled person. Reference is for example made to EP 0 542 810, WO 05/19824, WO 04/051268 and WO 04/106377. The screening of step b) is preferably performed using a flow cytometry technique such as FACS. For this, reference is for example made to Lieby et al., Blood, Vol. 97, No. 12, 3820. Particular reference is made to the so-called "Nanoclone™" technique described in International application WO 06/079372 by Ablynx N.V.

In another aspect, the method for generating an amino acid sequence directed against any of IL-17A, IL-17F and/or IL-17A/F including combinations thereof may comprise at least the steps of:

a) providing a set, collection or library of nucleic acid sequences encoding heavy chain antibodies or Nanobody (or ISV) sequences;
b) screening said set, collection or library of nucleic acid sequences for nucleic acid sequences that encode a heavy chain antibody or a Nanobody (or ISV) sequence that can bind to and/or has affinity for any of IL-17A, IL-17F and/or IL-17A/F including combinations thereof;

and c) isolating said nucleic acid sequence, followed by expressing the $V_{HH}$ sequence present in said heavy chain antibody or by expressing said Nanobody (or ISV) sequence, respectively.

In such a method, the set, collection or library of nucleic acid sequences encoding heavy chain antibodies or Nanobody (or ISV) sequences may for example be a set, collection or library of nucleic acid sequences encoding a naïve set, collection or library of heavy chain antibodies or $V_{HH}$ sequences; a set, collection or library of nucleic acid sequences encoding a synthetic or semi-synthetic set, collection or library of Nanobody (or ISV) sequences; and/or a set, collection or library of nucleic acid sequences encoding a set, collection or library of Nanobody (or ISV) sequences that have been subjected to affinity maturation.

In a preferred aspect of this method, the set, collection or library of nucleic acid sequences may be an immune set, collection or library of nucleic acid sequences encoding heavy chain antibodies or $V_{HH}$ sequences derived from a Camelid that has been suitably immunized with any of IL-17A, IL-17F and/or IL-17A/F including combinations thereof or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

In the above methods, the set, collection or library of nucleotide sequences may be displayed on a phage, phagemid, ribosome or suitable micro-organism (such as yeast), such as to facilitate screening. Suitable methods, techniques and host organisms for displaying and screening (a set, collection or library of) nucleotide sequences encoding amino acid sequences will be clear to the person skilled in the art, for example on the basis of the further disclosure herein. Reference is also made to WO 03/054016 and to the review by Hoogenboom in Nature Biotechnology, 23, 9, 1105-1116 (2005).

As will be clear to the skilled person, the screening step of the methods described herein can also be performed as a selection step. Accordingly the term "screening" as used in the present description can comprise selection, screening or any suitable combination of selection and/or screening techniques. Also, when a set, collection or library of sequences is used, it may contain any suitable number of sequences, such as 1, 2, 3 or about 5, 10, 50, 100, 500, 1000, 5000, $10^4$, $10^5$, $10^6$, $10^7$, $10^8$ or more sequences.

Also, one or more or all of the sequences in the above set, collection or library of amino acid sequences may be obtained or defined by rational, or semi-empirical approaches such as computer modelling techniques or biostatics or datamining techniques.

Furthermore, such a set, collection or library can comprise one, two or more sequences that are variants from one another (e.g. with designed point mutations or with randomized positions), compromise multiple sequences derived from a diverse set of naturally diversified sequences (e.g. an immune library)), or any other source of diverse sequences (as described for example in Hoogenboom et al, Nat Biotechnol 23:1105, 2005 and Binz et al, Nat Biotechnol 2005, 23:1247). Such set, collection or library of sequences can be displayed on the surface of a phage particle, a ribosome, a bacterium, a yeast cell, a mammalian cell, and linked to the nucleotide sequence encoding the amino acid sequence within these carriers. This makes such set, collection or library amenable to selection procedures to isolate the desired amino acid sequences of the invention. More generally, when a sequence is displayed on a suitable host or host cell, it is also possible (and customary) to first isolate from said host or host cell a nucleotide sequence that encodes the desired sequence, and then to obtain the desired sequence by suitably expressing said nucleotide sequence in a suitable host organism. Again, this can be performed in any suitable manner known per se, as will be clear to the skilled person.

Yet another technique for obtaining $V_{HH}$ sequences or Nanobody (or ISV) sequences directed against any of IL-17A, IL-17F and/or IL-17A/F including combinations thereof involves suitably immunizing a transgenic mammal that is capable of expressing heavy chain antibodies (i.e. so as to raise an immune response and/or heavy chain antibodies directed against any of IL-17A, IL-17F and/or IL-17A/F including combinations thereof), obtaining a suitable biological sample from said transgenic mammal that contains (nucleic acid sequences encoding) said $V_{HH}$ sequences or Nanobody (or ISV) sequences (such as a blood sample, serum sample or sample of B-cells), and then generating $V_{HH}$ sequences directed against any of IL-17A, IL-17F and/or IL-17A/F including combinations thereof, starting from said sample, using any suitable technique known per se (such as any of the methods described herein or a hybridoma technique). For example, for this purpose, the heavy chain antibody-expressing mice and the further methods and techniques described in WO 02/085945, WO 04/049794 and WO 06/008548 and Janssens et al., Proc. Natl. Acad. Sci. USA. 2006 Oct. 10; 103(41):15130-5 can be used. For example, such heavy chain antibody expressing mice can express heavy chain antibodies with any suitable (single) variable domain, such as (single) variable domains from natural sources (e.g. human (single) variable domains, Camelid (single) variable domains or shark (single) variable domains), as well as for example synthetic or semi-synthetic (single) variable domains.

The invention also relates to the $V_{HH}$ sequences or Nanobody (or ISV) sequences that are obtained by the above methods, or alternatively by a method that comprises the one of the above methods and in addition at least the steps of determining the nucleotide sequence or amino acid sequence of said $V_{HH}$ sequence or Nanobody (or ISV) sequence; and of expressing or synthesizing said $V_{HH}$ sequence or Nanobody (or ISV) sequence in a manner known per se, such as by expression in a suitable host cell or host organism or by chemical synthesis.

As mentioned herein, a particularly preferred class of Nanobodies (or ISV's) of the invention comprises Nanobodies (or ISV's) with an amino acid sequence that corresponds to the amino acid sequence of a naturally occurring $V_{HH}$ domain, but that has been "humanized", i.e. by replacing one or more amino acid residues in the amino acid sequence of said naturally occurring $V_{HH}$ sequence (and in particular in the framework sequences) by one or more of the amino acid residues that occur at the corresponding position(s) in a $V_H$ domain from a conventional 4-chain antibody from a human being (e.g. indicated above), as further described on, and using the techniques mentioned on, page 63 of WO 08/020,079. Another particularly preferred class of Nanobodies (or ISV's) of the invention comprises Nanobodies (or ISV's) with an amino acid sequence that corresponds to the amino acid sequence of a naturally occurring $V_H$ domain, but that has been "camelized", i.e. by replacing one or more amino acid residues in the amino acid sequence of a naturally occurring $V_H$ domain from a conventional 4-chain antibody by one or more of the amino acid residues that occur at the corresponding position(s) in a $V_{HH}$ domain of a heavy chain antibody, as further described on, and using the techniques mentioned on, page 63 of WO 08/020,079.

Other suitable methods and techniques for obtaining the Nanobodies (or ISV's) of the invention and/or nucleic acids encoding the same, starting from naturally occurring $V_H$ sequences or preferably $V_{HH}$ sequences, will be clear from the skilled person, and may for example include the techniques that are mentioned on page 64 of WO 08/00279. As mentioned herein, Nanobodies (or ISV's) may in particular be characterized by the presence of one or more "Hallmark residues" (as described herein) in one or more of the framework sequences.

Generally, immunoglobulin single variable domains (in particular $V_{HH}$ sequences and sequence optimized immunoglobulin single variable domains) can in particular be characterized by the presence of one or more "Hallmark residues" (as described herein) in one or more of the framework sequences (again as further described herein).

Thus, generally, an immunoglobulin single variable domain can be defined as an amino acid sequence with the (general) structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively.

In a preferred aspect, the invention provides polypeptides comprising at least an immunoglobulin single variable domain that is an amino acid sequence with the (general) structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:

i) at least one of the amino acid residues at positions 11, 37, 44, 45, 47, 83, 84, 103, 104 and 108 according to the Kabat numbering are chosen from the Hallmark residues mentioned in Table B-2 below; and in which:

ii) said amino acid sequence has at least 80%, more preferably 90%, even more preferably 95% amino acid identity with at least one of the immunoglobulin single variable domains as shown in WO 2009/138519 (see SEQ ID NO:s 1 to 125 herein, or in WO 2009/138519), in which for the purposes of determining the degree of amino acid identity, the amino acid residues that form the CDR sequences (indicated with X in the sequences) are disregarded; and in which:

iii) the CDR sequences are generally as further defined herein (e.g. the CDR1, CDR2 and CDR3 in a combination as provided in Table (B-2), note that the CDR definitions are calculated according to the Kabat numbering system).

TABLE B-2

Hallmark Residues in VHHs

| Position | Human $V_H3$ | Hallmark Residues |
|---|---|---|
| 11 | L, V; predominantly L | L, S, V, M, W, F, T, Q, E, A, R, G, K, Y, N, P, I; preferably L |
| 37 | V, I, F; usually V | $F^{(1)}$, Y, V, L, A, H, S, I, W, C, N, G, D, T, P, preferably $F^{(1)}$ or Y |
| $44^{(8)}$ | G | $E^{(3)}$, $Q^{(3)}$, $G^{(2)}$, D, A, K, R, L, P, S, V, H, T, N, W, M, I; preferably $G^{(2)}$, $E^{(3)}$ or $Q^{(3)}$; most preferably $G^{(2)}$ or $Q^{(3)}$. |
| $45^{(8)}$ | L | $L^{(2)}$, $R^{(3)}$, P, H, F, G, Q, S, E, T, Y, C, I, D, V; preferably $L^{(2)}$ or $R^{(3)}$ |
| $47^{(8)}$ | W, Y | $F^{(1)}$, $L^{(1)}$ or $W^{(2)}$ G, I, S, A, V, M, R, Y, E, P, T, C, H, K, Q, N, D; preferably $W^{(2)}$, $L^{(1)}$ or $F^{(1)}$ |
| 83 | R or K; usually R | R, $K^{(5)}$, T, $E^{(5)}$, Q, N, S, I, V, G, M, L, A, D, Y, H; preferably K or R; most preferably K |
| 84 | A, T, D; predominantly A | $P^{(5)}$, S, H, L, A, V, I, T, F, D, R, Y, N, Q, G, E; preferably P |
| 103 | W | $W^{(4)}$, $R^{(6)}$, G, S, K, A, M, Y, L, F, T, N, V, Q, $P^{(6)}$, E, C; preferably W |
| 104 | G | G, A, S, T, D, P, N, E, C, L; preferably G |
| 108 | L, M or T; predominantly L | Q, $L^{(7)}$, R, P, E, K, S, T, M, A, H; preferably Q or $L^{(7)}$ |

Notes:

(1)In particular, but not exclusively, in combination with KERE or KQRE at positions 43-46.

(2)Usually as GLEW at positions 44-47.

(3)Usually as KERE or KQRE at positions 43-46, e.g. as KEREL, KEREF, KQREL, KQREF, KEREG, KQREW or KQREG at positions 43-47. Alternatively, also sequences such as TERE (for example TEREL), TQRE (for example TQREL), KECE (for example KECEL or KECER), KQCE (for example KQCEL), RERE (for example REREG), RQRE (for example RQREL, RQREF or RQREW), QERE (for example QEREG), QQRE, (for example QQREW, QQREL or QQREF), KGRE (for example KGREG), KDRE (for example KDREV) are possible. Some other possible, but less preferred sequences include for example DECKL and NVCEL.

(4)With both GLEW at positions 44-47 and KERE or KQRE at positions 43-46.

(5)Often as KP or EP at positions 83-84 of naturally occurring $V_{HH}$ domains.

(6)In particular, but not exclusively, in combination with GLEW at positions 44-47.

(7)With the proviso that when positions 44-47 are GLEW, position 108 is always Q in (non-humanized) V sequences that also contain a W at 103.

(8)The GLEW group also contains GLEW-like sequences at positions 44-47, such as for example GVEW, EPEW, GLER, DQEW, DLEW, GIEW, ELEW, GPEW, EWLP, GPER, GLER and ELEW.

Again, such immunoglobulin single variable domains may be derived in any suitable manner and from any suitable source, and may for example be naturally occurring $V_{HH}$ sequences (i.e. from a suitable species of Camelid, e.g. llama) or synthetic or semi synthetic VHs or VLs (e.g. from human). Such immunoglobulin single variable domains may include "humanized" or otherwise "sequence optimized" VHHs, "camelized" immunoglobulin sequences (and in particular camelized heavy chain variable domain sequences, i.e. camelized VHs), as well as human VHs, human VLs, camelid VHHs that have been altered by techniques such as affinity maturation (for example, starting from synthetic, random or naturally occurring immunoglobulin sequences), CDR grafting, veneering, combining fragments derived from different immunoglobulin sequences, PCR assembly using overlapping primers, and similar techniques for engineering immunoglobulin sequences well known to the skilled person; or any suitable combination of any of the foregoing as further described herein.

In another preferred, but non-limiting aspect, the invention relates to a Nanobody (or ISV) as described above, in which the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NOs: 623 to 693 (see Table A-1). This degree of amino acid identity can for example be determined by determining the degree of amino acid identity (in a manner described herein) between said Nanobody (or ISV) and one or more of the sequences of SEQ ID NOs: 623 to 693 (see Table A-1), in which the amino acid residues that form the framework regions are disregarded. Such Nanobodies (or ISV's) can can be as further described herein.

As already mentioned herein, another preferred but non-limiting aspect of the invention relates to a Nanobody (or ISV) with an amino acid sequence that is chosen from the group consisting of SEQ ID NOs: 623 to 693 (see Table A-1) or from the group consisting of from amino acid sequences that have more than 80%, preferably more than 90%, more preferably more than 95%, such as 99% or more sequence identity (as defined herein) with at least one of the amino acid sequences of SEQ ID NOs: 623 to 693 (see Table A-1).

Also, in the above Nanobodies (or ISV's):

i) any amino acid substitution (when it is not a humanizing substitution as defined herein) is preferably, and compared to the corresponding amino acid sequence of SEQ ID NOs: 623 to 693 (see Table A-1), a conservative amino acid substitution, (as defined herein);

and/or:

ii) its amino acid sequence preferably contains either only amino acid substitutions, or otherwise preferably no more than 5, preferably no more than 3, and more preferably only 1 or 2 amino acid deletions or insertions, compared to the corresponding amino acid sequence of SEQ ID NOs: 623 to 693 (see Table A-1);

and/or iii) the CDR's may be CDR's that are derived by means of affinity maturation, for example starting from the CDR's of to the corresponding amino acid sequence of SEQ ID NOs: 623 to 693 (see Table A-1).

Preferably, the CDR sequences and FR sequences in the Nanobodies (or ISV's) of the invention are such that the Nanobodies (or ISV's) of the invention (and polypeptides of the invention comprising the same):

bind to any of IL-17A, IL-17F and/or IL-17A/F including combinations thereof with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);

and/or such that they:

bind to any of IL-17A, IL-17F and/or IL-17A/F including combinations thereof with a $k_{on}$-rate of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$;

and/or such that they:

bind to any of IL-17A, IL-17F and/or IL-17A/F including combinations thereof with a $k_{off}$ rate between 1 $s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-1}$ $s^{-1}$.

Preferably, CDR sequences and FR sequences present in the Nanobodies (or ISV's) of the invention are such that the Nanobodies (or ISV's) of the invention will bind to any of IL-17A, IL-17F and/or IL-17A/F including combinations thereof with an affinity less than 500 nM, preferably less than 200 nM, more preferably less than 10 nM, such as less than 500 pM.

According to one non-limiting aspect of the invention, a Nanobody (or ISV) may be as defined herein, but with the proviso that it has at least "one amino acid difference" (as defined herein) in at least one of the framework regions compared to the corresponding framework region of a naturally occurring human $V_H$ domain, and in particular compared to the corresponding framework region of DP-47. More specifically, according to one non-limiting aspect of the invention, a Nanobody (or ISV) may be as defined herein, but with the proviso that it has at least "one amino acid difference" (as defined herein) at at least one of the Hallmark residues (including those at positions 108, 103 and/or 45) compared to the corresponding framework region of a naturally occurring human $V_H$ domain, and in particular compared to the corresponding framework region of DP-47. Usually, a Nanobody (or ISV) will have at least one such amino acid difference with a naturally occurring $V_H$ domain in at least one of FR2 and/or FR4, and in particular at at least one of the Hallmark residues in FR2 and/or FR4 (again, including those at positions 108, 103 and/or 45).

Also, a humanized Nanobody (or ISV) of the invention may be as defined herein, but with the proviso that it has at least "one amino acid difference" (as defined herein) in at least one of the framework regions compared to the corresponding framework region of a naturally occurring $V_{HH}$ domain. More specifically, according to one non-limiting aspect of the invention, a humanized Nanobody (or ISV) may be as defined herein, but with the proviso that it has at least "one amino acid difference" (as defined herein) at at least one of the Hallmark residues (including those at positions 108, 103 and/or 45) compared to the corresponding framework region of a naturally occurring $V_{HH}$ domain. Usually, a humanized Nanobody (or ISV) will have at least one such amino acid difference with a naturally occurring $V_{HH}$ domain in at least one of FR2 and/or FR4, and in particular at at least one of the Hallmark residues in FR2 and/or FR4 (again, including those at positions 108, 103 and/or 45).

As will be clear from the disclosure herein, it is also within the scope of the invention to use natural or synthetic analogs, mutants, variants, alleles, homologs and orthologs (herein collectively referred to as "analogs") of the Nanobodies (or ISV's) of the invention as defined herein, and in particular analogs of the Nanobodies (or ISV's) of SEQ ID NOs 623 to 693 (see Table A-1). Thus, according to one aspect of the invention, the term "Nanobody (or ISV) of the invention" in its broadest sense also covers such analogs.

Generally, in such analogs, one or more amino acid residues may have been replaced, deleted and/or added, compared to the Nanobodies (or ISV's) of the invention as defined herein. Such substitutions, insertions or deletions may be made in one or more of the framework regions and/or in one or more of the CDR's. When such substitutions, insertions or deletions are made in one or more of the framework regions, they may be made at one or more of the Hallmark residues and/or at one or more of the other positions in the framework residues, although substitutions, insertions or deletions at the Hallmark residues are generally less preferred (unless these are suitable humanizing substitutions as described herein).

By means of non-limiting examples, a substitution may for example be a conservative substitution (as described herein) and/or an amino acid residue may be replaced by another amino acid residue that naturally occurs at the same position in another $V_{HH}$ domain (see Tables B-4 to B-7 for some non-limiting examples of such substitutions), although the invention is generally not limited thereto. Thus, any one or more substitutions, deletions or insertions, or any combination thereof, that either improve the properties of the Nanobody (or ISV) of the invention or that at least do not detract too much from the desired properties or from the balance or combination of desired properties of the Nanobody (or ISV) of the invention (i.e. to the extent that the Nanobody (or ISV) is no longer suited for its intended use) are included within the scope of the invention. A skilled person will generally be able to determine and select suitable substitutions, deletions or insertions, or suitable combinations of thereof, based on the disclosure herein and optionally after a limited degree of routine experimentation, which may for example involve introducing a limited number of possible substitutions and determining their influence on the properties of the Nanobodies (or ISV's) thus obtained.

For example, and depending on the host organism used to express the Nanobody (or ISV) or polypeptide of the invention, such deletions and/or substitutions may be designed in such a way that one or more sites for post-translational modification (such as one or more glycosylation sites) are removed, as will be within the ability of the person skilled in the art. Alternatively, substitutions or insertions may be designed so as to introduce one or more sites for attachment of functional groups (as described herein), for example to allow site-specific pegylation (again as described herein).

As can be seen from the data on the $V_{HH}$ entropy and $V_{HH}$ variability given in Tables B-4 to B-7 above, some amino acid residues in the framework regions are more conserved than others. Generally, although the invention in its broadest sense is not limited thereto, any substitutions, deletions or insertions are preferably made at positions that are less conserved. Also, generally, amino acid substitutions are preferred over amino acid deletions or insertions.

The analogs are preferably such that they can bind to any of IL-17A, IL-17F and/or IL-17A/F including combinations thereof with an affinity (suitably measured and/or expressed as a $K_D$-value (actual or apparent), a $K_A$-value (actual or apparent), a $k_{on}$-rate and/or a $k_{off}$-rate, or alternatively as an IC50 value, as further described herein) that is as defined herein for the Nanobodies (or ISV's) of the invention.

The analogs are preferably also such that they retain the favourable properties the Nanobodies (or ISV's), as described herein.

Also, according to one preferred aspect, the analogs have a degree of sequence identity of at least 70%, preferably at least 80%, more preferably at least 90%, such as at least 95% or 99% or more; and/or preferably have at most 20, preferably at most 10, even more preferably at most 5, such as 4, 3, 2 or only 1 amino acid difference (as defined herein), with one of the Nanobodies (or ISV's) of SEQ ID NOs: 623 to 693 (see Table A-1).

Also, the framework sequences and CDR's of the analogs are preferably such that they are in accordance with the preferred aspects defined herein. More generally, as described herein, the analogs will have (a) a Q at position 108; and/or (b) a charged amino acid or a cysteine residue at position 45 and preferably an E at position 44, and more preferably E at position 44 and R at position 45; and/or (c) P, R or S at position 103.

One preferred class of analogs of the Nanobodies (or ISV's) of the invention comprise Nanobodies (or ISV's) that have been humanized (i.e. compared to the sequence of a naturally occurring Nanobody (or ISV) of the invention). As mentioned in the background art cited herein, such humanization generally involves replacing one or more amino acid residues in the sequence of a naturally occurring $V_{HH}$ with the amino acid residues that occur at the same position in a human $V_H$ domain, such as a human $V_H3$ domain. Examples of possible humanizing substitutions or combinations of humanizing substitutions will be clear to the skilled person, for example from the Tables herein, from the possible humanizing substitutions mentioned in the background art cited herein, and/or from a comparison between the sequence of a Nanobody (or ISV) and the sequence of a naturally occurring human $V_H$ domain.

The humanizing substitutions should be chosen such that the resulting humanized Nanobodies (or ISV's) still retain the favourable properties of Nanobodies (or ISV's) as defined herein, and more preferably such that they are as described for analogs in the preceding paragraphs. A skilled person will generally be able to determine and select suitable humanizing substitutions or suitable combinations of humanizing substitutions, based on the disclosure herein and optionally after a limited degree of routine experimentation, which may for example involve introducing a limited number of possible humanizing substitutions and determining their influence on the properties of the Nanobodies (or ISV's) thus obtained.

Generally, as a result of humanization, the Nanobodies (or ISV's) of the invention may become more "human-like", while still retaining the favorable properties of the Nanobodies (or ISV's) of the invention as described herein. As a result, such humanized Nanobodies (or ISV's) may have several advantages, such as a reduced immunogenicity, compared to the corresponding naturally occurring $V_{HH}$ domains. Again, based on the disclosure herein and optionally after a limited degree of routine experimentation, the skilled person will be able to select humanizing substitutions or suitable combinations of humanizing substitutions which optimize or achieve a desired or suitable balance between the favourable properties provided by the humanizing substitutions on the one hand and the favourable properties of naturally occurring $V_{HH}$ domains on the other hand.

The Nanobodies (or ISV's) of the invention may be suitably humanized at any framework residue(s), such as at one or more Hallmark residues (as defined herein) or at one or more other framework residues (i.e. non-Hallmark residues) or any suitable combination thereof. One preferred humanizing substitution for Nanobodies (or ISV's) of the "P,R,S-103 group" or the "KERE group" is Q108 into L108. Nanobodies (or ISV's) of the "GLEW class" may also be humanized by a Q108 into L108 substitution, provided at least one of the other Hallmark residues contains a camelid (camelizing) substitution (as defined herein). For example, as mentioned above, one particularly preferred class of humanized Nanobodies (or ISV's) has GLEW or a GLEW-like sequence at positions 44-47; P, R or S (and in particular R) at position 103, and an L at position 108.

The humanized and other analogs, and nucleic acid sequences encoding the same, can be provided in any manner known per se, for example using one or more of the techniques mentioned on pages 103 and 104 of WO 08/020,079.

Also, in addition to humanizing substitutions as described herein, the amino acid sequences of the invention may contain one or more other/further substitutions. Again, some preferred, but non-limiting examples of such other/further substitutions will become clear from the further description herein, and for example may include (and preferably essentially consist of) one or more of the following substitutions:

(a) one or more conservative amino acid substitutions; and/or (b) one or more substitutions in which a "camelid" amino acid residue at a certain position is replaced by a different "camelid" amino acid residue that occurs at said position, for which reference is for example made to Tables A-6 to A-9 from PCT/EP2008/066365 (published on Jun. 4, 2009 as WO 09/068,627), which mention the various Camelid residues that occur as each amino acid position in wild-type VHH's. Such substitutions may even comprise suitable substitutions of an amino acid residue that occurs at a Hallmark position with another amino acid residue that occurring at a Hallmark position in a wild-type VHH (for which reference is for example made to Tables A-6 to A-9 from PCT/EP2008/066365); and/or (c) one or more substitutions that improve the (other) properties of the protein, such as substitutions that improve the long-term stability and/or properties under storage of the protein. These may for example and without limitation be substitutions that prevent or reduce oxidation events (for example, of methionine residues); that prevent or reduce pyroglutamate formation; and/or that prevent or reduce isomerisation or deamidation of aspartic acids or asparagines (for example, of DG, DS, NG or NS motifs). For such substitutions, reference is for example made to the International application WO 09/095,235, which is generally directed to methods for stabilizing single immunoglobulin variable domains by means of such substitutions, and also gives some specific example of suitable substitutions (see for example pages 4 and 5 and pages 10 to 15). One example of such substitution may be to replace an NS motif at positions 82a and 82b with an NN motif (cf. Table B-6 of the present description);

(d) one or more substitutions that improve expression levels in an intended host cell or host organism and/or other properties that are relevant for production/expression in a desired host cell or host organism. These may for example also include substitutions that remove possible sites for (undesired) post-translational modification and/or that otherwise reduce (undesired) post-translational modification (such as, for example and without limitation, possible glycosylation or phosphorylation), depending on the host cell or host organism to be used for expression/production; and also for example removing sites that may be susceptible to proteolytic cleavage (again, depending on the host cell or host organism to be used)

Some specific, but non-limiting examples of humanized and/or sequenced-optimized amino acid sequences of the invention are given in FIG. 7 and in SEQ ID NOs: 760 to 825, and each of these forms a further aspect of the present invention. Based on the further disclosure herein, the skilled person will be able to provide other humanized and/or sequenced-optimized amino acid sequences of the invention.

FIG. 8 and SEQ ID NOs: 826 to 837 give some preferred, but non-limiting examples of polypeptides of the invention based on humanized and/or sequenced-optimized amino acid sequences of the invention as building blocks, and each of these forms a further aspect of the present invention. Based on the further disclosure herein, the skilled person will be able to provide other compounds and/or polypeptides of the invention that are based humanized and/or sequenced-optimized amino acid sequences of the invention.

As mentioned there, it will be also be clear to the skilled person that the Nanobodies (or ISV's) of the invention (including their analogs) can be designed and/or prepared starting from human $V_H$ sequences (i.e. amino acid sequences or the corresponding nucleotide sequences), such as for example from human $V_H3$ sequences such as DP-47, DP-51 or DP-29, i.e. by introducing one or more camelizing substitutions (i.e. changing one or more amino acid residues in the amino acid sequence of said human $V_H$ domain into the amino acid residues that occur at the corresponding position in a $V_{HH}$ domain), so as to provide the sequence of a Nanobody (or ISV) of the invention and/or so as to confer the favourable properties of a Nanobody (or ISV) to the sequence thus obtained. Again, this can generally be performed using the various methods and techniques referred to in the previous paragraph, using an amino acid sequence and/or nucleotide sequence for a human $V_H$ domain as a starting point.

Some preferred, but non-limiting camelizing substitutions can be derived from Tables B-4-B-7. It will also be clear that camelizing substitutions at one or more of the Hallmark residues will generally have a greater influence on the desired properties than substitutions at one or more of the other amino acid positions, although both and any suitable combination thereof are included within the scope of the invention. For example, it is possible to introduce one or more camelizing substitutions that already confer at least some the desired properties, and then to introduce further camelizing substitutions that either further improve said properties and/or confer additional favourable properties. Again, the skilled person will generally be able to determine and select suitable camelizing substitutions or suitable combinations of camelizing substitutions, based on the disclosure herein and optionally after a limited degree of routine experimentation, which may for example involve introducing a limited number of possible camelizing substitutions and determining whether the favourable properties of Nanobodies (or ISV's) are obtained or improved (i.e. compared to the original $V_H$ domain).

Generally, however, such camelizing substitutions are preferably such that the resulting an amino acid sequence at least contains (a) a Q at position 108; and/or (b) a charged amino acid or a cysteine residue at position 45 and preferably also an E at position 44, and more preferably E at position 44 and R at position 45; and/or (c) P, R or S at position 103; and optionally one or more further camelizing substitutions. More preferably, the camelizing substitutions are such that they result in a Nanobody (or ISV) of the invention and/or in an analog thereof (as defined herein), such as in a humanized analog and/or preferably in an analog that is as defined in the preceding paragraphs.

Nanobodies (or ISV's) can also be derived from $V_H$ domains by the incorporation of substitutions that are rare in nature, but nonetheless, structurally compatible with the VH domain fold. For example, but without being limiting, these substitutions may include on or more of the following: Gly at position 35, Ser, Val or Thr at position 37, Ser, Thr, Arg, Lys, His, Asp or Glu at position 39, Glu or His at position 45, Trp, Leu, Val, Ala, Thr, or Glu at position 47, S or R at position 50. (Barthelemy et al. J Biol. Chem. 2008 Feb. 8; 283(6):3639-54. Epub 2007 Nov. 28)

As will also be clear from the disclosure herein, it is also within the scope of the invention to use parts or fragments, or combinations of two or more parts or fragments, of the Nanobodies (or ISV's) of the invention as defined herein, and in particular parts or fragments of the Nanobodies (or ISV's) of SEQ ID NOs: 623 to 693 (see Table A-1). Thus, according to one aspect of the invention, the term "Nanobody (or ISV) of the invention" in its broadest sense also covers such parts or fragments.

Generally, such parts or fragments of the Nanobodies (or ISV's) of the invention (including analogs thereof) have amino acid sequences in which, compared to the amino acid sequence of the corresponding full length Nanobody (or ISV) of the invention (or analog thereof), one or more of the amino acid residues at the N-terminal end, one or more amino acid residues at the C-terminal end, one or more contiguous internal amino acid residues, or any combination thereof, have been deleted and/or removed.

The parts or fragments are preferably such that they can bind to any of IL-17A, IL-17F and/or IL-17A/F including combinations thereof with an affinity (suitably measured and/or expressed as a $K_D$-value (actual or apparent), a $K_A$-value (actual or apparent), a $k_{on}$-rate and/or a $k_{off}$-rate, or alternatively as an IC50 value, as further described herein) that is as defined herein for the Nanobodies (or ISV's) of the invention.

Any part or fragment is preferably such that it comprises at least 10 contiguous amino acid residues, preferably at least 20 contiguous amino acid residues, more preferably at least 30 contiguous amino acid residues, such as at least 40 contiguous amino acid residues, of the amino acid sequence of the corresponding full length Nanobody (or ISV) of the invention.

Also, any part or fragment is such preferably that it comprises at least one of CDR1, CDR2 and/or CDR3 or at least part thereof (and in particular at least CDR3 or at least part thereof). More preferably, any part or fragment is such that it comprises at least one of the CDR's (and preferably at least CDR3 or part thereof) and at least one other CDR (i.e. CDR1 or CDR2) or at least part thereof, preferably connected by suitable framework sequence(s) or at least part thereof. More preferably, any part or fragment is such that it comprises at least one of the CDR's (and preferably at least CDR3 or part thereof) and at least part of the two remaining CDR's, again preferably connected by suitable framework sequence(s) or at least part thereof.

According to another particularly preferred, but non-limiting aspect, such a part or fragment comprises at least CDR3, such as FR3, CDR3 and FR4 of the corresponding full length Nanobody (or ISV) of the invention, i.e. as for example described in the International application WO 03/050531 (Lasters et al.).

As already mentioned above, it is also possible to combine two or more of such parts or fragments (i.e. from the same or different Nanobodies (or ISV's) of the invention), i.e. to provide an analog (as defined herein) and/or to provide further parts or fragments (as defined herein) of a Nanobody (or ISV) of the invention. It is for example also possible to combine one or more parts or fragments of a Nanobody (or ISV) of the invention with one or more parts or fragments of a human $V_H$ domain.

According to one preferred aspect, the parts or fragments have a degree of sequence identity of at least 50%, preferably at least 60%, more preferably at least 70%, even more preferably at least 80%, such as at least 90%, 95% or 99% or more with one of the Nanobodies (or ISV's) of SEQ ID NO:s 623 to 693 (see Table A-1).

The parts and fragments, and nucleic acid sequences encoding the same, can be provided and optionally combined in any manner known per se. For example, such parts or fragments can be obtained by inserting a stop codon in a nucleic acid that encodes a full-sized Nanobody (or ISV) of the invention, and then expressing the nucleic acid thus obtained in a manner known per se (e.g. as described herein). Alternatively, nucleic acids encoding such parts or fragments can be obtained by suitably restricting a nucleic acid that encodes a full-sized Nanobody (or ISV) of the invention or by synthesizing such a nucleic acid in a manner known per se. Parts or fragments may also be provided using techniques for peptide synthesis known per se.

The invention in its broadest sense also comprises derivatives of the Nanobodies (or ISV's) of the invention. Such derivatives can generally be obtained by modification, and in particular by chemical and/or biological (e.g enzymatical) modification, of the Nanobodies (or ISV's) of the invention and/or of one or more of the amino acid residues that form the Nanobodies (or ISV's) of the invention.

Examples of such modifications, as well as examples of amino acid residues within the Nanobody (or ISV) sequence that can be modified in such a manner (i.e. either on the protein backbone but preferably on a side chain), methods and techniques that can be used to introduce such modifications and the potential uses and advantages of such modifications will be clear to the skilled person.

For example, such a modification may involve the introduction (e.g. by covalent linking or in an other suitable manner) of one or more functional groups, residues or moieties into or onto the Nanobody (or ISV) of the invention, and in particular of one or more functional groups, residues or moieties that confer one or more desired properties or functionalities to the Nanobody (or ISV) of the invention. Example of such functional groups will be clear to the skilled person.

For example, such modification may comprise the introduction (e.g. by covalent binding or in any other suitable manner) of one or more functional groups that increase the half-life, the solubility and/or the absorption of the Nanobody (or ISV) of the invention, that reduce the immunogenicity and/or the toxicity of the Nanobody (or ISV) of the invention, that eliminate or attenuate any undesirable side effects of the Nanobody (or ISV) of the invention, and/or that confer other advantageous properties to and/or reduce the undesired properties of the Nanobodies (or ISV's) and/or polypeptides of the invention; or any combination of two or more of the foregoing. Examples of such functional groups and of techniques for introducing them will be clear to the skilled person, and can generally comprise all functional groups and techniques mentioned in the general background art cited hereinabove as well as the functional groups and techniques known per se for the modification of pharmaceutical proteins, and in particular for the modification of antibodies or antibody fragments (including ScFv's and single domain antibodies), for which reference is for example made to Remington's Pharmaceutical Sciences, 16th ed., Mack Publishing Co., Easton, Pa. (1980). Such functional groups may for example be linked directly (for example covalently) to a Nanobody (or ISV) of the invention, or optionally via a suitable linker or spacer, as will again be clear to the skilled person.

One of the most widely used techniques for increasing the half-life and/or reducing the immunogenicity of pharmaceutical proteins comprises attachment of a suitable pharmacologically acceptable polymer, such as poly(ethyleneglycol) (PEG) or derivatives thereof (such as methoxypoly(ethyleneglycol) or mPEG). Generally, any suitable form of pegylation can be used, such as the pegylation used in the art for antibodies and antibody fragments (including but not limited to (single) domain antibodies and ScFv's); reference is made to for example Chapman, Nat. Biotechnol., 54, 531-545 (2002); by Veronese and Harris, Adv. Drug Deliv. Rev. 54, 453-456 (2003), by Harris and Chess, Nat. Rev. Drug. Discov., 2, (2003) and in WO 04/060965. Various reagents for pegylation of proteins are also commercially available, for example from Nektar Therapeutics, USA.

Preferably, site-directed pegylation is used, in particular via a cysteine-residue (see for example Yang et al., Protein Engineering, 16, 10, 761-770 (2003). For example, for this purpose, PEG may be attached to a cysteine residue that naturally occurs in a Nanobody (or ISV) of the invention, a Nanobody (or ISV) of the invention may be modified so as to suitably introduce one or more cysteine residues for attachment of PEG, or an amino acid sequence comprising one or more cysteine residues for attachment of PEG may be fused to the N- and/or C-terminus of a Nanobody (or ISV) of the invention, all using techniques of protein engineering known per se to the skilled person.

Preferably, for the Nanobodies (or ISV's) and proteins of the invention, a PEG is used with a molecular weight of more than 5000, such as more than 10,000 and less than 200,000, such as less than 100,000; for example in the range of 20,000-80,000.

Another, usually less preferred modification comprises N-linked or O-linked glycosylation, usually as part of co-translational and/or post-translational modification, depending on the host cell used for expressing the Nanobody (or ISV) or polypeptide of the invention.

Yet another modification may comprise the introduction of one or more detectable labels or other signal-generating groups or moieties, depending on the intended use of the labelled Nanobody (or ISV). Suitable labels and techniques for attaching, using and detecting them will be clear to the skilled person, and for example include, but are not limited to, the fluorescent labels, phosphorescent labels, chemiluminescent labels, bioluminescent labels, radio-isotopes, metals, metal chelates, metallic cations, chromophores and enzymes, such as those mentioned on page 109 of WO 08/020,079. Other suitable labels will be clear to the skilled person, and for example include moieties that can be detected using NMR or ESR spectroscopy.

Such labelled Nanobodies (or ISV's) and polypeptides of the invention may for example be used for in vitro, in vivo or in situ assays (including immunoassays known per se such as ELISA, RIA, EIA and other "sandwich assays", etc.) as well as in vivo diagnostic and imaging purposes, depending on the choice of the specific label.

As will be clear to the skilled person, another modification may involve the introduction of a chelating group, for example to chelate one of the metals or metallic cations referred to above. Suitable chelating groups for example include, without limitation, diethyl-enetriaminepentaacetic acid (DTPA) or ethylenediaminetetraacetic acid (EDTA).

Yet another modification may comprise the introduction of a functional group that is one part of a specific binding pair, such as the biotin-(strept)avidin binding pair. Such a functional group may be used to link the Nanobody (or ISV) of the invention to another protein, polypeptide or chemical compound that is bound to the other half of the binding pair, i.e. through formation of the binding pair. For example, a Nanobody (or ISV) of the invention may be conjugated to biotin, and linked to another protein, polypeptide, compound or carrier conjugated to avidin or streptavidin. For example, such a conjugated Nanobody (or ISV) may be used as a reporter, for example in a diagnostic system where a detectable signal-producing agent is conjugated to avidin or streptavidin. Such binding pairs may for example also be used to bind the Nanobody (or ISV) of the invention to a carrier, including carriers suitable for pharmaceutical purposes. One non-limiting example are the liposomal formulations described by Cao and Suresh, Journal of Drug Targetting, 8, 4, 257 (2000). Such binding pairs may also be used to link a therapeutically active agent to the Nanobody (or ISV) of the invention.

For some applications, in particular for those applications in which it is intended to kill a cell that expresses the target against which the Nanobodies (or ISV's) of the invention are directed (e.g. in the treatment of cancer), or to reduce or slow the growth and/or proliferation such a cell, the Nanobodies (or ISV's) of the invention may also be linked to a toxin or to a toxic residue or moiety. Examples of toxic moieties, compounds or residues which can be linked to a Nanobody (or ISV) of the invention to provide—for example—a cytotoxic compound will be clear to the skilled person and can for example be found in the prior art cited above and/or in the further description herein. One example is the so-called ADEPT™ technology described in WO 03/055527.

Other potential chemical and enzymatical modifications will be clear to the skilled person. Such modifications may also be introduced for research purposes (e.g. to study function-activity relationships). Reference is for example made to Lundblad and Bradshaw, Biotechnol. Appl. Biochem., 26, 143-151 (1997).

Preferably, the derivatives are such that they bind to any of IL-17A, IL-17F and/or IL-17A/F including combinations thereof with an affinity (suitably measured and/or expressed as a $K_D$-value (actual or apparent), a $K_A$-value (actual or apparent), a $k_{on}$-rate and/or a $k_{off}$-rate, or alternatively as an IC50 value, as further described herein) that is as defined herein for the Nanobodies (or ISV's) of the invention.

As mentioned above, the invention also relates to proteins or polypeptides that essentially consist of or comprise at least one Nanobody (or ISV) of the invention. By "essentially consist of" is meant that the amino acid sequence of the polypeptide of the invention either is exactly the same as the amino acid sequence of a Nanobody (or ISV) of the invention or corresponds to the amino acid sequence of a Nanobody (or ISV) of the invention which has a limited number of amino acid residues, such as 1-20 amino acid residues, for example 1-10 amino acid residues and preferably 1-6 amino acid residues, such as 1, 2, 3, 4, 5 or 6 amino acid residues, added at the amino terminal end, at the carboxy terminal end, or at both the amino terminal end and the carboxy terminal end of the amino acid sequence of the Nanobody (or ISV).

Said amino acid residues may or may not change, alter or otherwise influence the (biological) properties of the Nanobody (or ISV) and may or may not add further functionality to the Nanobody (or ISV). For example, such amino acid residues:

- can comprise an N-terminal Met residue, for example as result of expression in a heterologous host cell or host organism.
- may form a signal sequence or leader sequence that directs secretion of the Nanobody (or ISV) from a host cell upon synthesis. Suitable secretory leader peptides will be clear to the skilled person, and may be as further described herein. Usually, such a leader sequence will be linked to the N-terminus of the Nanobody (or ISV), although the invention in its broadest sense is not limited thereto;
- may form a sequence or signal that allows the Nanobody (or ISV) to be directed towards and/or to penetrate or enter into specific organs, tissues, cells, or parts or compartments of cells, and/or that allows the Nanobody (or ISV) to penetrate or cross a biological barrier such as a cell membrane, a cell layer such as a layer of epithelial cells, a tumor including solid tumors, or the blood-brain-barrier. Examples of such amino acid sequences will be clear to the skilled person and include those mentioned in paragraph c) on page 112 of WO 08/020,079.
- may form a "tag", for example an amino acid sequence or residue that allows or facilitates the purification of the Nanobody (or ISV), for example using affinity techniques directed against said sequence or residue. Thereafter, said sequence or residue may be removed (e.g. by chemical or enzymatical cleavage) to provide the Nanobody (or ISV) sequence (for this purpose, the tag may optionally be linked to the Nanobody (or ISV) sequence via a cleavable linker sequence or contain a cleavable motif). Some preferred, but non-limiting examples of such residues are multiple histidine residues, glutatione residues and a myc-tag (see for example SEQ ID NO:31 of WO 06/12282).
- may be one or more amino acid residues that have been functionalized and/or that can serve as a site for attachment of functional groups. Suitable amino acid residues and functional groups will be clear to the skilled person and include, but are not limited to, the amino acid residues and functional groups mentioned herein for the derivatives of the Nanobodies (or ISV's) of the invention.

According to one embodiment, a polypeptide of the invention comprises or consists of an amino acid sequence selected from any of SEQ ID NO: 623 to 693 and 826-838 (i.e. selected from SEQ ID NO 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693, 826, 827, 828, 829, 830, 831, 832, 833, 834, 835, 836, 837 and SEQ ID NO 838), wherein the amino acid sequence may comprise up to 6 single amino acid substitutions, deletions and/or insertions and wherein the polypeptide preferably specifically binds to IL-17A and/or to IL-17-F.

According to another embodiment, a polypeptide of the invention comprises or consists of an amino acid sequence selected from any of SEQ ID NO: 623 to 693 and 826-838 (i.e. selected from SEQ ID NO 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693, 826, 827, 828, 829, 830, 831, 832, 833, 834, 835, 836, 837 and SEQ ID NO 838), wherein the amino acid sequence may comprise up to 6 single amino acid substitutions, deletions and/or insertions and wherein the polypeptide preferably binds to IL 17A and/or to IL 17-F with a Kd of less than 5 nM and most preferably with a Kd of less than 50 pM.

According to one embodiment, a polypeptide of the invention comprises or consists of an amino acid sequence selected from any of SEQ ID NO: 623 to 693 and 826-838 (i.e. selected from SEQ ID NO 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693, 826, 827, 828, 829, 830, 831, 832, 833, 834, 835, 836, 837 and SEQ ID NO 838), wherein the amino acid sequence may comprise up to 3 single amino acid substitutions, deletions and/or insertions and wherein the polypeptide preferably specifically binds to IL 17A and/or to IL 17-F.

According to one embodiment, a polypeptide of the invention comprises or consists of the amino acid sequence SEQ ID NO 836, wherein the amino acid sequence may comprise up to 1, 2, 3, 4, 5, 6, 7, 8, 9 or up to 10 single amino acid substitutions, deletions and/or insertions and wherein the polypeptide preferably specifically binds to IL 17A and/or to IL 17-F with a Kd of less than 5 nM and most preferably with a Kd of less than 50 pM.

According to a further embodiment, a polypeptide of the invention comprises or consists of an amino acid sequence selected from any of SEQ ID NO: 623 to 693 and 826-838 (i.e. selected from SEQ ID NO 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693, 826, 827, 828, 829, 830, 831, 832, 833, 834, 835, 836, 837 and SEQ ID NO 838), wherein the amino acid sequence may comprise up to 6 single amino acid substitutions, deletions and/or insertions and wherein the polypeptide preferably specifically binds to SEQ ID NO: 839 and/or to SEQ ID NO: 840, preferably with a Kd of less than 5 nM and most preferably with a Kd of less than 50 pM.

According to a further embodiment, a polypeptide of the invention comprises or consists of an amino acid sequence selected from any of SEQ ID NO: 623 to 693 and 826-838 (i.e. selected from SEQ ID NO 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693, 826, 827, 828, 829, 830, 831, 832, 833, 834, 835, 836, 837 and SEQ ID NO 838), wherein the amino acid sequence may comprise up to 3 single amino acid substitutions, deletions and/or insertions and wherein the polypeptide preferably specifically binds to SEQ ID NO: 839 and/or to SEQ ID NO: 840, preferably with a Kd of less than 5 nM and most preferably with a Kd of less than 50 pM.

Also provided is a polypeptide of the invention, wherein the polypeptide comprises (i) a first amino acid sequence selected from any of SEQ ID NO: 640-649 (i.e. selected from any of SEQ ID NO 640, 641, 642, 643, 644, 645, 646, 647, 648 and 649), which specifically binds to IL-17F (SEQ ID NO: 840) and to a heterodimer of IL-17A (SEQ ID NO: 839) and IL-17F (SEQ ID NO: 840), but does not specifically bind to IL-17A (SEQ ID NO: 839); and/or (ii) a second amino acid sequence selected from any of SEQ ID NO: 650-693 (i.e. selected from any of SEQ ID NO 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693), which specifically binds to IL-17A (SEQ ID NO: 839), to IL-17F (SEQ ID NO: 840) and to a heterodimer of IL-17A (SEQ ID NO: 839) and IL-17F (SEQ ID NO: 840);

wherein the first and second amino acid sequence may in total comprise up to 6 single amino acid substitutions, deletions and/or insertions; and wherein said specific binding in each instance occurs with a Kd of less than 5 nM.

According to another aspect, a polypeptide of the invention comprises a Nanobody (or ISV) of the invention, which specifically binds to at least amino acids L74, Y85 and N88 of IL-17A (SEQ ID NO: 839). These binding epitopes have been shown to be of therapeutic value.

According to another aspect, a polypeptide of the invention comprises a Nanobody (or ISV) of the invention, which specifically binds to at least amino acids R47, R73, I86 and N89 of IL-17F (SEQ ID NO: 840). These binding epitopes have been shown to be of therapeutic value.

Of course also all of the above polypeptides can be used and are effective for the treatment of a disease as disclosed herein.

According to another aspect, a polypeptide of the invention comprises a Nanobody (or ISV) of the invention, which is fused at its amino terminal end, at its carboxy terminal end, or both at its amino terminal end and at its carboxy terminal end to at least one further amino acid sequence, i.e. so as to provide a fusion protein comprising said Nanobody (or ISV) of the invention and the one or more further amino acid sequences. Such a fusion will also be referred to herein as a "Nanobody (or ISV) fusion".

The one or more further amino acid sequence may be any suitable and/or desired amino acid sequences. The further amino acid sequences may or may not change, alter or otherwise influence the (biological) properties of the Nanobody (or ISV), and may or may not add further functionality to the Nanobody (or ISV) or the polypeptide of the invention. Preferably, the further amino acid sequence is such that it confers one or more desired properties or functionalities to the Nanobody (or ISV) or the polypeptide of the invention.

For example, the further amino acid sequence may also provide a second binding site, which binding site may be directed against any desired protein, polypeptide, antigen, antigenic determinant or epitope (including but not limited to the same protein, polypeptide, antigen, antigenic determinant or epitope against which the Nanobody (or ISV) of the invention is directed, or a different protein, polypeptide, antigen, antigenic determinant or epitope).

Example of such amino acid sequences will be clear to the skilled person, and may generally comprise all amino acid sequences that are used in peptide fusions based on conventional antibodies and fragments thereof (including but not limited to ScFv's and single domain antibodies). Reference is for example made to the review by Holliger and Hudson, Nature Biotechnology, 23, 9, 1126-1136 (2005).

For example, such an amino acid sequence may be an amino acid sequence that increases the half-life, the solubility, or the absorption, reduces the immunogenicity or the toxicity, eliminates or attenuates undesirable side effects, and/or confers other advantageous properties to and/or reduces the undesired properties of the polypeptides of the invention, compared to the Nanobody (or ISV) of the invention per se. Some non-limiting examples of such amino acid sequences are serum proteins, such as human serum albumin (see for example WO 00/27435) or haptenic molecules (for example haptens that are recognized by circulating antibodies, see for example WO 98/22141).

In particular, it has been described in the art that linking fragments of immunoglobulins (such as $V_H$ domains) to serum albumin or to fragments thereof can be used to increase the half-life. Reference is for made to WO 00/27435 and WO 01/077137). According to the invention, the Nanobody (or ISV) of the invention is preferably either directly linked to serum albumin (or to a suitable fragment thereof) or via a suitable linker, and in particular via a suitable peptide linked so that the polypeptide of the invention can be expressed as a genetic fusion (protein). According to one specific aspect, the Nanobody (or ISV) of the invention may be linked to a fragment of serum albumin that at least comprises the domain III of serum albumin or part thereof. Reference is for example made to WO 07/112,940 of Ablynx N.V.

Alternatively, the further amino acid sequence may provide a second binding site or binding unit that is directed against a serum protein (such as, for example, human serum albumin or another serum protein such as IgG), so as to provide increased half-life in serum. Such amino acid sequences for example include the Nanobodies (or ISV's) described below, as well as the small peptides and binding proteins described in WO 91/01743, WO 01/45746 and WO 02/076489 and the dAb's described in WO 03/002609 and WO 04/003019. Reference is also made to Harmsen et al., Vaccine, 23 (41); 4926-42, 2005, as well as to EP 0 368 684, as well as to WO 08/028,977, WO 08/043,821, WO 08/043,822 by Ablynx N.V. and US provisional application of Ablynx N.V. entitled "Peptides capable of binding to serum proteins" filed on Dec. 5, 2006 ((see also PCT/EP2007/063348).

Such amino acid sequences may in particular be directed against serum albumin (and more in particular human serum albumin) and/or against IgG (and more in particular human IgG). For example, such amino acid sequences may be amino acid sequences that are directed against (human) serum albumin and amino acid sequences that can bind to amino acid residues on (human) serum albumin that are not involved in binding of serum albumin to FcRn (see for example WO 06/0122787) and/or amino acid sequences that are capable of binding to amino acid residues on serum albumin that do not form part of domain III of serum albumin (see again for example WO 06/0122787); amino acid sequences that have or can provide an increased half-life (see for example WO 08/028,977 by Ablynx N.V.); amino acid sequences against human serum albumin that are cross-reactive with serum albumin from at least one species of mammal, and in particular with at least one species of primate (such as, without limitation, monkeys from the genus *Macaca* (such as, and in particular, cynomolgus monkeys (*Macaca fascicularis*) and/or rhesus monkeys (*Macaca mulatta*)) and baboon (*Papio ursinus*), reference is again made to WO 08/028,977; amino acid sequences that can bind to serum albumin in a pH independent manner (see for example WO 08/043,821 by Ablynx N.V. entitled "Amino acid sequences that bind to serum proteins in a manner that is essentially independent of the pH, compounds comprising the same, and uses thereof") and/or amino acid sequences that are conditional binders (see for example WO 08/043,822 by Ablynx N.V. entitled "Amino acid sequences that bind to a desired molecule in a conditional manner").

According to another aspect, the one or more further amino acid sequences may comprise one or more parts, fragments or domains of conventional 4-chain antibodies (and in particular human antibodies) and/or of heavy chain antibodies. For example, although usually less preferred, a Nanobody (or ISV) of the invention may be linked to a conventional (preferably human) $V_H$ or $V_L$ domain or to a natural or synthetic analog of a $V_H$ or $V_L$ domain, again optionally via a linker sequence (including but not limited to other (single) domain antibodies, such as the dAb's described by Ward et al.).

The at least one Nanobody (or ISV) may also be linked to one or more (preferably human) $C_H1$, $C_H2$ and/or $C_H3$ domains, optionally via a linker sequence. For instance, a Nanobody (or ISV) linked to a suitable $C_H1$ domain could for example be used—together with suitable light chains—to generate antibody fragments/structures analogous to conventional Fab fragments or $F(ab')_2$ fragments, but in which one or (in case of an $F(ab')_2$ fragment) one or both of the conventional $V_H$ domains have been replaced by a Nanobody (or ISV) of the invention. Also, two Nanobodies (or ISV's) could be linked to a $C_H3$ domain (optionally via a linker) to provide a construct with increased half-life in vivo.

According to one specific aspect of a polypeptide of the invention, one or more Nanobodies (or ISV's) of the invention may be linked (optionally via a suitable linker or hinge region) to one or more constant domains (for example, 2 or 3 constant domains that can be used as part of/to form an Fc portion), to an Fc portion and/or to to one or more antibody parts, fragments or domains that confer one or more effector functions to the polypeptide of the invention and/or may confer the ability to bind to one or more Fc receptors. For example, for this purpose, and without being limited thereto, the one or more further amino acid sequences may comprise one or more $C_H2$ and/or $C_H3$ domains of an antibody, such as from a heavy chain antibody (as described herein) and more preferably from a conventional human 4-chain antibody; and/or may form (part of) and Fc region, for example from IgG (e.g. from IgG1, IgG2, IgG3 or IgG4), from IgE or from another human Ig such as IgA, IgD or IgM. For example, WO 94/04678 describes heavy chain antibodies comprising a Camelid $V_{HH}$ domain or a humanized derivative thereof (i.e. a Nanobody (or ISV)), in which the Camelidae $C_H2$ and/or $C_H3$ domain have been replaced by human $C_H2$ and $C_H3$ domains, so as to provide an immunoglobulin that consists of 2 heavy chains each comprising a Nanobody (or ISV) and human $C_H2$ and $C_H3$ domains (but no $C_H1$ domain), which immunoglobulin has the effector function provided by the $C_H2$ and $C_H3$ domains and which immunoglobulin can function without the presence of any light chains. Other amino acid sequences that can be suitably linked to the Nanobodies (or ISV's) of the invention so as to provide an effector function will be clear to the skilled person, and may be chosen on the basis of the desired effector function(s). Reference is for example made to WO 04/058820, WO 99/42077, WO 02/056910 and WO 05/017148, as well as the review by Holliger and Hudson, supra; and to the non-prepublished US provisional application by Ablynx N.V. entitled "Constructs comprising single variable domains and an Fc portion derived from IgE" which has a filing date of Dec. 4, 2007. Coupling of a Nanobody (or ISV) of the invention to an Fc portion may also lead to an increased half-life, compared to the corresponding Nanobody (or ISV) of the invention. For some applications, the use of an Fc portion and/or of constant domains (i.e. $C_H2$ and/or $C_H3$ domains) that confer increased half-life without any biologically significant effector function may also be suitable or even preferred. Other suitable constructs comprising one or more Nanobodies (or ISV's) and one or more constant domains with increased half-life in vivo will be clear to the skilled person, and may for example comprise two Nanobodies (or ISV's) linked to a $C_H3$ domain, optionally via a linker sequence. Generally, any fusion protein or derivatives with increased half-life will preferably have a molecular weight of more than 50 kD, the cut-off value for renal absorption.

In another one specific, but non-limiting, aspect, in order to form a polypeptide of the invention, one or more amino acid sequences of the invention may be linked (optionally via a suitable linker or hinge region) to naturally occurring, synthetic or semisynthetic constant domains (or analogs, variants, mutants, parts or fragments thereof) that have a reduced (or essentially no) tendency to self-associate into dimers (i.e. compared to constant domains that naturally occur in conventional 4-chain antibodies). Such monomeric (i.e. not self-associating) Fc chain variants, or fragments thereof, will be clear to the skilled person. For example, Helm et al., J Biol Chem 1996 271 7494, describe monomeric Fcγ chain variants that can be used in the polypeptide chains of the invention.

Also, such monomeric Fc chain variants are preferably such that they are still capable of binding to the complement or the relevant Fc receptor(s) (depending on the Fc portion from which they are derived), and/or such that they still have some or all of the effector functions of the Fc portion from which they are derived (or at a reduced level still suitable for the intended use). Alternatively, in such a polypeptide chain of the invention, the monomeric Fc chain may be used to confer increased half-life upon the polypeptide chain, in which case the monomeric Fc chain may also have no or essentially no effector functions.

Bivalent/multivalent, bispecific/multispecific or biparatopic/multiparatopic polypeptides of the invention may also be linked to Fc portions, in order to provide polypeptide constructs of the type that is described in the non-prepublished U.S. provisional application US 61/005,331 entitled "immunoglobulin constructs" filed on Dec. 4, 2007.

The further amino acid sequences may also form a signal sequence or leader sequence that directs secretion of the Nanobody (or ISV) or the polypeptide of the invention from a host cell upon synthesis (for example to provide a pre-, pro- or prepro-form of the polypeptide of the invention, depending on the host cell used to express the polypeptide of the invention).

The further amino acid sequence may also form a sequence or signal that allows the Nanobody (or ISV) or polypeptide of the invention to be directed towards and/or to penetrate or enter into specific organs, tissues, cells, or parts or compartments of cells, and/or that allows the Nanobody (or ISV) or polypeptide of the invention to penetrate or cross a biological barrier such as a cell membrane, a cell layer such as a layer of epithelial cells, a tumor including solid tumors, or the blood-brain-barrier. Suitable examples of such amino acid sequences will be clear to the skilled person, and for example include, but are not limited to, those mentioned on page 118 of WO 08/020,079. For some applications, in particular for those applications in which it is intended to kill a cell that expresses the target against which the Nanobodies (or ISV's) of the invention are directed (e.g. in the treatment of cancer), or to reduce or slow the growth and/or proliferation of such a cell, the Nanobodies (or ISV's) of the invention may also be linked to a (cyto)toxic protein or polypeptide. Examples of such toxic proteins and polypeptides which can be linked to a Nanobody (or ISV) of the invention to provide—for example—a cytotoxic polypeptide of the invention will be clear to the skilled person and can for example be found in the prior art cited above and/or in the further description herein. One example is the so-called ADEPT™ technology described in WO 03/055527.

According to one preferred, but non-limiting aspect, said one or more further amino acid sequences comprise at least one further Nanobody (or ISV), so as to provide a polypeptide of the invention that comprises at least two, such as three, four, five or more Nanobodies (or ISV's), in which said Nanobodies (or ISV's) may optionally be linked via one or more linker sequences (as defined herein). As described on pages 119 and 120 of WO 08/020,079, polypeptides of the invention that comprise two or more Nanobodies (or ISV's), of which at least one is a Nanobody (or ISV) of the invention, will also be referred to herein as "multivalent" polypeptides of the invention, and the Nanobodies (or ISV's) present in such polypeptides will also be referred to herein as being in a "multivalent format". For example, "bivalent" and "trivalent" polypeptides of the invention may be as further described on pages 119 and 120 of WO 08/020,079.

Polypeptides of the invention that contain at least two Nanobodies (or ISV's), in which at least one Nanobody (or ISV) is directed against a first antigen (i.e. against any of IL-17A, IL-17F and/or IL-17A/F including combinations thereof) and at least one Nanobody (or ISV) is directed against a second antigen (i.e. different from any of IL-17A, IL-17F and/or IL-17A/F including combinations thereof), will also be referred to as "multispecific" polypeptides of the invention, and the Nanobodies (or ISV's) present in such polypeptides will also be referred to herein as being in a "multispecific format". Thus, for example, a "bispecific" polypeptide of the invention is a polypeptide that comprises at least one Nanobody (or ISV) directed against a first antigen (i.e. any of IL-17A, IL-17F and/or IL-17A/F including combinations thereof) and at least one further Nanobody (or ISV) directed against a second antigen (i.e. different from any of IL-17A, IL-17F and/or IL-17A/F including combinations thereof), whereas a "trispecific" polypeptide of the invention is a polypeptide that comprises at least one Nanobody (or ISV) directed against a first antigen (i.e. any of IL-17A, IL-17F and/or IL-17A/F including combinations thereof), at least one further Nanobody (or ISV) directed against a second antigen (i.e. different from any of IL-17A, IL-17F and/or IL-17A/F including combinations thereof) and at least one further Nanobody (or ISV) directed against a third antigen (i.e. different from both any of IL-17A, IL-17F and/or IL-17A/F including combinations thereof, and the second antigen); etc.

Accordingly, in its simplest form, a bispecific polypeptide of the invention is a bivalent polypeptide of the invention (as defined herein), comprising a first Nanobody (or ISV) directed against any of IL-17A, IL-17F and/or IL-17A/F including combinations thereof, and a second Nanobody (or ISV) directed against a second antigen, in which said first and second Nanobody (or ISV) may optionally be linked via a linker sequence (as defined herein); whereas a trispecific polypeptide of the invention in its simplest form is a trivalent polypeptide of the invention (as defined herein), comprising a first Nanobody (or ISV) directed against any of IL-17A, IL-17F and/or IL-17A/F including combinations thereof, a second Nanobody (or ISV) directed against a second antigen and a third Nanobody (or ISV) directed against a third antigen, in which said first, second and third Nanobody (or ISV) may optionally be linked via one or more, and in particular one and more, in particular two, linker sequences.

However, as will be clear from the description hereinabove, the invention is not limited thereto, in the sense that a multispecific polypeptide of the invention may comprise at least one Nanobody (or ISV) against any of IL-17A, IL-17F and/or IL-17A/F including combinations thereof, and any number of Nanobodies (or ISV's) directed against one or more antigens different from any of IL-17A, IL-17F and/or IL-17A/F including combinations thereof.

Furthermore, although it is encompassed within the scope of the invention that the specific order or arrangement of the various Nanobodies (or ISV's) in the polypeptides of the invention may have some influence on the properties of the final polypeptide of the invention (including but not limited to the affinity, specificity or avidity for any of IL-17A, IL-17F and/or IL-17A/F including combinations thereof, or against the one or more other antigens), said order or arrangement is usually not critical and may be suitably chosen by the skilled person, optionally after some limited routine experiments based on the disclosure herein. Thus, when reference is made to a specific multivalent or multispecific polypeptide of the invention, it should be noted that this encompasses any order or arrangements of the relevant Nanobodies (or ISV's), unless explicitly indicated otherwise.

Finally, it is also within the scope of the invention that the polypeptides of the invention contain two or more Nanobodies (or ISV's) and one or more further amino acid sequences (as mentioned herein).

For multivalent and multispecific polypeptides containing one or more $V_{HH}$ domains and their preparation, reference is also made to Conrath et al., J. Biol. Chem., Vol. 276, 10. 7346-7350, 2001; Muyldermans, Reviews in Molecular Biotechnology 74 (2001), 277-302; as well as to for example WO 96/34103 and WO 99/23221. Some other examples of some specific multispecific and/or multivalent polypeptide of the invention can be found in the applications by Ablynx N.V. referred to herein.

One preferred, but non-limiting example of a multispecific polypeptide of the invention comprises at least one Nanobody (or ISV) of the invention and at least one Nanobody (or ISV) that provides for an increased half-life. Such Nanobodies (or ISV's) may for example be Nanobodies (or ISV's) that are directed against a serum protein, and in particular a human serum protein, such as human serum albumin, thyroxine-binding protein, (human) transferrin, fibrinogen, an immunoglobulin such as IgG, IgE or IgM, or against one of the serum proteins listed in WO 04/003019. Of these, Nanobodies (or ISV's) that can bind to serum albumin (and in particular human serum albumin) or to IgG (and in particular human IgG, see for example Nanobody (or ISV) VH-1 described in the review by Muyldermans, supra) are particularly preferred (although for example, for experiments in mice or primates, Nanobodies (or ISV's) against or cross-reactive with mouse serum albumin (MSA) or serum albumin from said primate, respectively, can be used, however, for pharmaceutical use, Nanobodies (or ISV's) against human serum albumin or human IgG will usually be preferred). Nanobodies (or ISV's) that provide for increased half-life and that can be used in the polypeptides of the invention include the Nanobodies (or ISV's) directed against serum albumin that are described in WO 04/041865, in WO 06/122787 and in the further patent applications by Ablynx N.V., such as those mentioned above.

For example, the some preferred Nanobodies (or ISV's) that provide for increased half-life for use in the present invention include Nanobodies (or ISV's) that can bind to amino acid residues on (human) serum albumin that are not involved in binding of serum albumin to FcRn (see for example WO 06/0122787); Nanobodies (or ISV's) that are capable of binding to amino acid residues on serum albumin that do not form part of domain III of serum albumin (see for example WO 06/0122787); Nanobodies (or ISV's) that have or can provide an increased half-life (see for example WO 08/028,977 by Ablynx N.V mentioned herein); Nanobodies (or ISV's) against human serum albumin that are cross-reactive with serum albumin from at least one species of mammal, and in particular with at least one species of primate (such as, without limitation, monkeys from the genus *Macaca* (such as, and in particular, cynomolgus monkeys (*Macaca fascicularis*) and/or rhesus monkeys (*Macaca mulatta*)) and baboon (*Papio ursinus*)) (see for example WO 08/028,977 by Ablynx N.V)); Nanobodies (or ISV's) that can bind to serum albumin in a pH independent manner (see for example WO2008/043821 by Ablynx N.V. mentioned herein) and/or Nanobodies (or ISV's) that are conditional binders (see for example WO 08/043,822 by Ablynx N.V.).

Some particularly preferred Nanobodies (or ISV's) that provide for increased half-life and that can be used in the polypeptides of the invention include the Nanobodies (or ISV's) ALB-1 to ALB-10 disclosed in WO 06/122787 (see Tables II and III) of which ALB-8 (SEQ ID NO: 62 in WO 06/122787) is particularly preferred.

According to a specific, but non-limiting aspect of the invention, the polypeptides of the invention contain, besides the one or more Nanobodies (or ISV's) of the invention, at least one Nanobody (or ISV) against human serum albumin.

Generally, any polypeptide of the invention with increased half-life that contains one or more Nanobodies (or ISV's) of the invention, and any derivatives of Nanobodies (or ISV's) of the invention or of such polypeptides that have an increased half-life, preferably have a half-life that is at least 1.5 times, preferably at least 2 times, such as at least 5 times, for example at least 10 times or more than 20 times, greater than the half-life of the corresponding Nanobody (or ISV) of the invention per se. For example, such a derivative or polypeptides with increased half-life may have a half-life that is increased with more than 1 hours, preferably more than 2 hours, more preferably more than 6 hours, such as more than 12 hours, or even more than 24, 48 or 72 hours, compared to the corresponding Nanobody (or ISV) of the invention per se.

In a preferred, but non-limiting aspect of the invention, such derivatives or polypeptides may exhibit a serum half-life in human of at least about 12 hours, preferably at least 24 hours, more preferably at least 48 hours, even more preferably at least 72 hours or more. For example, such derivatives or polypeptides may have a half-life of at least 5 days (such as about 5 to 10 days), preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days).

According to one aspect of the invention the polypeptides are capable of binding to one or more molecules which can increase the half-life of the polypeptide in vivo. The polypeptides of the invention are stabilised in vivo and their half-life increased by binding to molecules which resist degradation and/or clearance or sequestration. Typically, such molecules are naturally occurring proteins which themselves have a long half-life in vivo. Another preferred, but non-limiting example of a multispecific polypeptide of the invention comprises at least one Nanobody (or ISV) of the invention and at least one Nanobody (or ISV) that directs the polypeptide of the invention towards, and/or that allows the polypeptide of the invention to penetrate or to enter into specific organs, tissues, cells, or parts or compartments of cells, and/or that allows the Nanobody (or ISV) to penetrate or cross a biological barrier such as a cell membrane, a cell layer such as a layer of epithelial cells, a tumor including solid tumors, or the blood-brain-barrier. Examples of such Nanobodies (or ISV's) include Nanobodies (or ISV's) that are directed towards specific cell-surface proteins, markers or epitopes of the desired organ, tissue or cell (for example cell-surface markers associated with tumor cells), and the single-domain brain targeting antibody fragments described in WO 02/057445 and WO 06/040153, of which FC44 (SEQ ID NO: 189 of WO 06/040153) and FC5 (SEQ ID NO: 190 of WO 06/040154) are preferred examples. In the polypeptides of the invention, the one or more Nanobodies (or ISV's) and the one or more polypeptides may be directly linked to each other (as for example described in WO 99/23221) and/or may be linked to each other via one or more suitable spacers or linkers, or any combination thereof.

Suitable spacers or linkers for use in multivalent and multispecific polypeptides will be clear to the skilled person, and may generally be any linker or spacer used in the art to link amino acid sequences. Preferably, said linker or spacer is suitable for use in constructing proteins or polypeptides that are intended for pharmaceutical use. Some particularly preferred spacers include the spacers and linkers that are used in the art to link antibody fragments or antibody domains. These include the linkers mentioned in the general background art cited above, as well as for example linkers that are used in the art to construct diabodies or ScFv fragments (in this respect, however, its should be noted that, whereas in diabodies and in ScFv fragments, the linker sequence used should have a length, a degree of flexibility and other properties that allow the pertinent $V_H$ and $V_L$ domains to come together to form the complete antigen-binding site, there is no particular limitation on the length or the flexibility of the linker used in the polypeptide of the invention, since each Nanobody (or ISV) by itself forms a complete antigen-binding site). For example, a linker may be a suitable amino acid sequence, and in particular amino acid sequences of between 1 and 50, preferably between 1 and 30, such as between 1 and 10 amino acid residues. Some preferred examples of such amino acid sequences include gly-ser linkers, for example of the type $(gly_x ser_y)_z$, such as (for example $(gly_4ser)_3$ or $(gly_3ser_2)_3$, as described in WO 99/42077 and the GS30, GS15, GS9 and GS7 linkers described in the applications by Ablynx mentioned herein (see for example WO 06/040153 and WO 06/122825), as well as hinge-like regions, such as the hinge regions of naturally occurring heavy chain antibodies or similar sequences (such as described in WO 94/04678). Some other particularly preferred linkers are poly-alanine (such as AAA), as well as the linkers GS30 (SEQ ID NO: 85 in WO 06/122825) and GS9 (SEQ ID NO: 84 in WO 06/122825). Other suitable linkers generally comprise organic compounds or polymers, in particular those suitable for use in proteins for pharmaceutical use. For instance, poly(ethyleneglycol) moieties have been used to link antibody domains, see for example WO 04/081026. It is encompassed within the scope of the invention that the length, the degree of flexibility and/or other properties of the linker(s) used (although not critical, as it usually is for linkers used in ScFv fragments) may have some influence on the properties of the final polypeptide of the invention, including but not limited to the affinity, specificity or avidity for any of IL-17A, IL-17F and/or IL-17A/F including combinations thereof, or for one or more of the other antigens. Based on the disclosure herein, the skilled person will be able to determine the optimal linker(s) for use in a specific polypeptide of the invention, optionally after some limited routine experiments. For example, in multivalent polypeptides of the invention that comprise Nanobodies (or ISV's) directed against a multimeric antigen (such as a multimeric receptor or other protein), the length and flexibility of the linker are preferably such that it allows each Nanobody (or ISV) of the invention present in the polypeptide to bind to the antigenic determinant on each of the subunits of the multimer. Similarly, in a multispecific polypeptide of the invention that comprises Nanobodies (or ISV's) directed against two or more different antigenic determinants on the same antigen (for example against different epitopes of an antigen and/or against different subunits of a multimeric receptor, channel or protein), the length and flexibility of the linker are preferably such that it allows each Nanobody (or ISV) to bind to its intended antigenic determinant. Again, based on the disclosure herein, the skilled person will be able to determine the optimal linker(s) for use in a specific polypeptide of the invention, optionally after some limited routine experiments. It is also within the scope of the invention that the linker(s) used confer one or more other favourable properties or functionality to the polypeptides of the invention, and/or provide one or more sites for the formation of derivatives and/or for the attachment of functional groups (e.g. as described herein for the derivatives of the Nanobodies (or ISV's) of the invention). For example, linkers containing one or more charged amino acid residues (see Table A-2 on page 48 of the International application WO 08/020,079) can provide improved hydrophilic properties, whereas linkers that form or contain small epitopes or tags can be used for the purposes of detection, identification and/or purification. Again, based on the disclosure herein, the skilled person will be able to determine the optimal linkers for use in a specific polypeptide of the invention, optionally after some limited routine experiments. Finally, when two or more linkers are used in the polypeptides of the invention, these linkers may be the same or different. Again, based on the disclosure herein, the skilled person will be able to determine the optimal linkers for use in a specific polypeptide of the invention, optionally after some limited routine experiments. Usually, for easy of expression and production, a polypeptide of the invention will be a linear polypeptide. However, the invention in its broadest sense is not limited thererto. For example, when a polypeptide of the invention comprises three of more Nanobodies (or ISV's), it is possible to link them by use of a linker with three or more "arms", which each "arm" being linked to a Nanobody (or ISV), so as to provide a "star-shaped" construct. It is also possible, although usually less preferred, to use circular constructs. The invention also comprises derivatives of the polypeptides of the invention, which may be essentially analogous to the derivatives of the Nanobodies (or ISV's) of the invention, i.e. as described herein. The invention also comprises proteins or polypeptides that "essentially consist" of a polypeptide of the invention (in which the wording "essentially consist of" has essentially the same meaning as indicated hereinabove).

According to one aspect of the invention, the polypeptide of the invention is in essentially isolated from, as defined herein. The amino acid sequences, Nanobodies (or ISV's), polypeptides and nucleic acids of the invention can be prepared in a manner known per se, as will be clear to the skilled person from the further description herein. For example, the Nanobodies (or ISV's) and polypeptides of the invention can be prepared in any manner known per se for the preparation of antibodies and in particular for the preparation of antibody fragments (including but not limited to (single) domain antibodies and ScFv fragments). Some preferred, but non-limiting methods for preparing the amino acid sequences, Nanobodies (or ISV's), polypeptides and nucleic acids include the methods and techniques described herein.

As will be clear to the skilled person, one particularly useful method for preparing an amino acid sequence, Nanobody (or ISV) and/or a polypeptide of the invention generally comprises the steps of:

i) the expression, in a suitable host cell or host organism (also referred to herein as a "host of the invention") or in another suitable expression system of a nucleic acid that encodes said amino acid sequence, Nanobody (or ISV) or polypeptide of the invention (also referred to herein as a "nucleic acid of the invention"), optionally followed by:
ii) isolating and/or purifying the amino acid sequence, Nanobody (or ISV) or polypeptide of the invention thus obtained.

In particular, such a method may comprise the steps of:

i) cultivating and/or maintaining a host of the invention under conditions that are such that said host of the invention expresses and/or produces at least one amino acid sequence, Nanobody (or ISV) and/or polypeptide of the invention; optionally followed by:
ii) isolating and/or purifying the amino acid sequence, Nanobody (or ISV) or polypeptide of the invention thus obtained.

A nucleic acid of the invention can be in the form of single or double stranded DNA or RNA, and is preferably in the form of double stranded DNA. For example, the nucleotide sequences of the invention may be genomic DNA, cDNA or synthetic DNA (such as DNA with a codon usage that has been specifically adapted for expression in the intended host cell or host organism). According to one aspect of the invention, the nucleic acid of the invention is in essentially isolated from, as defined herein. The nucleic acid of the invention may also be in the form of, be present in and/or be part of a vector, such as for example a plasmid, cosmid or YAC, which again may be in essentially isolated form. The nucleic acids of the invention can be prepared or obtained in a manner known per se, based on the information on the amino acid sequences for the polypeptides of the invention given herein, and/or can be isolated from a suitable natural source. To provide analogs, nucleotide sequences encoding naturally occurring $V_{HH}$ domains can for example be subjected to site-directed mutagenesis, so at to provide a nucleic acid of the invention encoding said analog. Also, as will be clear to the skilled person, to prepare a nucleic acid of the invention, also several nucleotide sequences, such as at least one nucleotide sequence encoding a Nanobody (or ISV) and for example nucleic acids encoding one or more linkers can be linked together in a suitable manner. Techniques for generating the nucleic acids of the invention will be clear to the skilled person and may for instance include, but are not limited to, automated DNA synthesis; site-directed mutagenesis; combining two or more naturally occurring and/or synthetic sequences (or two or more parts thereof), introduction of mutations that lead to the expression of a truncated expression product; introduction of one or more restriction sites (e.g. to create cassettes and/or regions that may easily be digested and/or ligated using suitable restriction enzymes), and/or the introduction of mutations by means of a PCR reaction using one or more "mismatched" primers, using for example a sequence of a naturally occurring form of any of IL-17A, IL-17F and/or IL-17A/F including combinations thereof as a template. These and other techniques will be clear to the skilled person, and reference is again made to the standard handbooks, such as Sambrook et al. and Ausubel et al., mentioned above, as well as the Examples below. The nucleic acid of the invention may also be in the form of, be present in and/or be part of a genetic construct, as will be clear to the person skilled in the art and as described on pages 131-134 of WO 08/020,079 (incorporated herein by reference). Such genetic constructs generally comprise at least one nucleic acid of the invention that is optionally linked to one or more elements of genetic constructs known per se, such as for example one or more suitable regulatory elements (such as a suitable promoter(s), enhancer(s), terminator(s), etc.) and the further elements of genetic constructs referred to herein. Such genetic constructs comprising at least one nucleic acid of the invention will also be referred to herein as "genetic constructs of the invention". The genetic constructs of the invention may be DNA or RNA, and are preferably double-stranded DNA. The genetic constructs of the invention may also be in a form suitable for transformation of the intended host cell or host organism, in a form suitable for integration into the genomic DNA of the intended host cell or in a form suitable for independent replication, maintenance and/or inheritance in the intended host organism. For instance, the genetic constructs of the invention may be in the form of a vector, such as for example a plasmid, cosmid, YAC, a viral vector or transposon. In particular, the vector may be an expression vector, i.e. a vector that can provide for expression in vitro and/or in vivo (e.g. in a suitable host cell, host organism and/or expression system).

In a preferred but non-limiting aspect, a genetic construct of the invention comprises i) at least one nucleic acid of the invention; operably connected to ii) one or more regulatory elements, such as a promoter and optionally a suitable terminator;

and optionally also iii) one or more further elements of genetic constructs known per se;

in which the terms "operably connected" and "operably linked" have the meaning given on pages 131-134 of WO 08/020,079; and in which the "regulatory elements", "promoter", "terminator" and "further elements" are as described on pages 131-134 of WO 08/020,079; and in which the genetic constructs may further be as described on pages 131-134 of WO 08/020,079.

The nucleic acids of the invention and/or the genetic constructs of the invention may be used to transform a host cell or host organism, i.e. for expression and/or production of the amino acid sequence, Nanobody (or ISV) or polypeptide of the invention. Suitable hosts or host cells will be clear to the skilled person, and may for example be any suitable fungal, prokaryotic or eukaryotic cell or cell line or any suitable fungal, prokaryotic or eukaryotic organism, for example those described on pages 134 and 135 of WO 08/020,079; as well as all other hosts or host cells known per se for the expression and production of antibodies and antibody fragments (including but not limited to (single) domain antibodies and ScFv fragments), which will be clear to the skilled person. Reference is also made to the general background art cited hereinabove, as well as to for example WO 94/29457; WO 96/34103; WO 99/42077; Frenken et al., (1998), supra; Riechmann and Muyldermans, (1999), supra; van der Linden, (2000), supra; Thomassen et al., (2002), supra; Joosten et al., (2003), supra; Joosten et al., (2005), supra; and the further references cited herein.

The amino acid sequences, Nanobodies (or ISV's) and polypeptides of the invention can also be introduced and expressed in one or more cells, tissues or organs of a multicellular organism, for example for prophylactic and/or therapeutic purposes (e.g. as a gene therapy), as further described on pages 135 and 136 of in WO 08/020,079 and in the further references cited in WO 08/020,079.

For expression of the Nanobodies (or ISV's) in a cell, they may also be expressed as so-called "intrabodies", as for example described in WO 94/02610, WO 95/22618 and U.S. Pat. No. 7,004,940; WO 03/014960; in Cattaneo, A. & Biocca, S. (1997) Intracellular Antibodies: Development and Applications. Landes and Springer-Verlag; and in Kontermann, Methods 34, (2004), 163-170.

The amino acid sequences, Nanobodies (or ISV's) and polypeptides of the invention can for example also be produced in the milk of transgenic mammals, for example in the milk of rabbits, cows, goats or sheep (see for example U.S. Pat. No. 6,741,957, U.S. Pat. No. 6,304,489 and U.S. Pat. No. 6,849,992 for general techniques for introducing transgenes into mammals), in plants or parts of plants including but not limited to their leaves, flowers, fruits, seed, roots or turbers (for example in tobacco, maize, soybean or alfalfa) or in for example pupae of the silkworm *Bombix mori*.

Furthermore, the amino acid sequences, Nanobodies (or ISV's) and polypeptides of the invention can also be expressed and/or produced in cell-free expression systems, and suitable examples of such systems will be clear to the skilled person. Some preferred, but non-limiting examples include expression in the wheat germ system; in rabbit reticulocyte lysates; or in the *E. coli* Zubay system.

As mentioned above, one of the advantages of the use of Nanobodies (or ISV's) is that the polypeptides based thereon can be prepared through expression in a suitable bacterial system, and suitable bacterial expression systems, vectors, host cells, regulatory elements, etc., will be clear to the skilled person, for example from the references cited above. It should however be noted that the invention in its broadest sense is not limited to expression in bacterial systems.

Preferably, in the invention, an (in vivo or in vitro) expression system, such as a bacterial expression system, is used that provides the polypeptides of the invention in a form that is suitable for pharmaceutical use, and such expression systems will again be clear to the skilled person. As also will be clear to the skilled person, polypeptides of the invention suitable for pharmaceutical use can be prepared using techniques for peptide synthesis.

For production on industrial scale, preferred heterologous hosts for the (industrial) production of Nanobodies (or ISV's) or Nanobody (or ISV)-containing protein therapeutics include strains of *E. coli, Pichia pastoris, S. cerevisiae* that are suitable for large scale expression/production/fermentation, and in particular for large scale pharmaceutical (i.e. GMP grade) expression/production/fermentation. Suitable examples of such strains will be clear to the skilled person. Such strains and production/expression systems are also made available by companies such as Biovitrum (Uppsala, Sweden).

Alternatively, mammalian cell lines, in particular Chinese hamster ovary (CHO) cells, can be used for large scale expression/production/fermentation, and in particular for large scale pharmaceutical expression/production/fermentation. Again, such expression/production systems are also made available by some of the companies mentioned above. The choice of the specific expression system would depend in part on the requirement for certain post-translational modifications, more specifically glycosylation. The production of a Nanobody (or ISV)-containing recombinant protein for which glycosylation is desired or required would necessitate the use of mammalian expression hosts that have the ability to glycosylate the expressed protein. In this respect, it will be clear to the skilled person that the glycosylation pattern obtained (i.e. the kind, number and position of residues attached) will depend on the cell or cell line that is used for the expression. Preferably, either a human cell or cell line is used (i.e. leading to a protein that essentially has a human glycosylation pattern) or another mammalian cell line is used that can provide a glycosylation pattern that is essentially and/or functionally the same as human glycosylation or at least mimics human glycosylation. Generally, prokaryotic hosts such as *E. coli* do not have the ability to glycosylate proteins, and the use of lower eukaryotes such as yeast usually leads to a glycosylation pattern that differs from human glycosylation. Nevertheless, it should be understood that all the foregoing host cells and expression systems can be used in the invention, depending on the desired amino acid sequence, Nanobody (or ISV) or polypeptide to be obtained. Thus, according to one non-limiting aspect of the invention, the amino acid sequence, Nanobody (or ISV) or polypeptide of the invention is glycosylated. According to another non-limiting aspect of the invention, the amino acid sequence, Nanobody (or ISV) or polypeptide of the invention is non-glycosylated. According to one preferred, but non-limiting aspect of the invention, the amino acid sequence, Nanobody (or ISV) or polypeptide of the invention is produced in a bacterial cell, in particular a bacterial cell suitable for large scale pharmaceutical production, such as cells of the strains mentioned above. According to another preferred, but non-limiting aspect of the invention, the amino acid sequence, Nanobody (or ISV) or polypeptide of the invention is produced in a yeast cell, in particular a yeast cell suitable for large scale pharmaceutical production, such as cells of the species mentioned above. According to yet another preferred, but non-limiting aspect of the invention, the amino acid sequence, Nanobody (or ISV) or polypeptide of the invention is produced in a mammalian cell, in particular in a human cell or in a cell of a human cell line, and more in particular in a human cell or in a cell of a human cell line that is suitable for large scale pharmaceutical production, such as the cell lines mentioned hereinabove. As further described on pages 138 and 139 of WO 08/020,079, when expression in a host cell is used to produce the amino acid sequences, Nanobodies (or ISV's) and the polypeptides of the invention, the amino acid sequences, Nanobodies (or ISV's) and polypeptides of the invention can be produced either intracellullarly (e.g. in the cytosol, in the periplasma or in inclusion bodies) and then isolated from the host cells and optionally further purified; or can be produced extracellularly (e.g. in the medium in which the host cells are cultured) and then isolated from the culture medium and optionally further purified. Thus, according to one non-limiting aspect of the invention, the amino acid sequence, Nanobody (or ISV) or polypeptide of the invention is an amino acid sequence, Nanobody (or ISV) or polypeptide that has been produced intracellularly and that has been isolated from the host cell, and in particular from a bacterial cell or from an inclusion body in a bacterial cell. According to another non-limiting aspect of the invention, the amino acid sequence, Nanobody (or ISV) or polypeptide of the invention is an amino acid sequence, Nanobody (or ISV) or polypeptide that has been produced extracellularly, and that has been isolated from the medium in which the host cell is cultivated. Some preferred, but non-limiting promoters for use with these host cells include those mentioned on pages 139 and 140 of WO 08/020,079. Some preferred, but non-limiting secretory sequences for use with these host cells include those mentioned on page 140 of WO 08/020,079. Suitable techniques for transforming a host or host cell of the invention will be clear to the skilled person and may depend on the intended host cell/host organism and the genetic construct to be used. Reference is again made to the handbooks and patent applications mentioned above. After transformation, a step for detecting and selecting those host cells or host organisms that have been successfully transformed with the nucleotide sequence/genetic construct of the invention may be performed. This may for instance be a selection step based on a selectable marker present in the genetic construct of the invention or a step involving the detection of the amino acid sequence of the invention, e.g. using specific antibodies. The transformed host cell (which may be in the form or a stable cell line) or host organisms (which may be in the form of a stable mutant line or strain) form further aspects of the present invention. Preferably, these host cells or host organisms are such that they express, or are (at least) capable of expressing (e.g. under suitable conditions), an amino acid sequence, Nanobody (or ISV) or polypeptide of the invention (and in case of a host organism: in at least one cell, part, tissue or organ thereof). The invention also includes further generations, progeny and/or offspring of the host cell or host organism of the invention, that may for instance be obtained by cell division or by sexual or asexual reproduction. To produce/obtain expression of the amino acid sequences of the invention, the transformed host cell or transformed host organism may generally be kept, maintained and/or cultured under conditions such that the (desired) amino acid sequence, Nanobody (or ISV) or polypeptide of the invention is expressed/produced. Suitable conditions will be clear to the skilled person and will usually depend upon the host cell/host organism used, as well as on the regulatory elements that control the expression of the (relevant) nucleotide sequence of the invention. Again, reference is made to the handbooks and patent applications mentioned above in the paragraphs on the genetic constructs of the invention. Generally, suitable conditions may include the use of a suitable medium, the presence of a suitable source of food and/or suitable nutrients, the use of a suitable temperature, and optionally the presence of a suitable inducing factor or compound (e.g. when the nucleotide sequences of the invention are under the control of an inducible promoter); all of which may be selected by the skilled person. Again, under such conditions, the amino acid sequences of the invention may be expressed in a constitutive manner, in a transient manner, or only when suitably induced.

It will also be clear to the skilled person that the amino acid sequence, Nanobody (or ISV) or polypeptide of the invention may (first) be generated in an immature form (as mentioned above), which may then be subjected to post-translational modification, depending on the host cell/host organism used. Also, the amino acid sequence, Nanobody (or ISV) or polypeptide of the invention may be glycosylated, again depending on the host cell/host organism used. The amino acid sequence, Nanobody (or ISV) or polypeptide of the invention may then be isolated from the host cell/host organism and/or from the medium in which said host cell or host organism was cultivated, using protein isolation and/or purification techniques known per se, such as (preparative) chromatography and/or electrophoresis techniques, differential precipitation techniques, affinity techniques (e.g. using a specific, cleavable amino acid sequence fused with the amino acid sequence, Nanobody (or ISV) or polypeptide of the invention) and/or preparative immunological techniques (i.e. using antibodies against the amino acid sequence to be isolated). Generally, for pharmaceutical use, the polypeptides of the invention may be formulated as a pharmaceutical preparation or compositions comprising at least one polypeptide of the invention and at least one pharmaceutically acceptable carrier, diluent or excipient and/or adjuvant, and optionally one or more further pharmaceutically active polypeptides and/or compounds. By means of non-limiting examples, such a formulation may be in a form suitable for oral administration, for parenteral administration (such as by intravenous, intramuscular or subcutaneous injection or intravenous infusion), for topical administration, for administration by inhalation, by a skin patch, by an implant, by a suppository, etc. Such suitable administration forms—which may be solid, semi-solid or liquid, depending on the manner of administration—as well as methods and carriers for use in the preparation thereof, will be clear to the skilled person, and are further described herein. Thus, in a further aspect, the invention relates to a pharmaceutical composition that contains at least one amino acid of the invention, at least one Nanobody (or ISV) of the invention or at least one polypeptide of the invention and at least one suitable carrier, diluent or excipient (i.e. suitable for pharmaceutical use), and optionally one or more further active substances. Generally, the amino acid sequences, Nanobodies (or ISV's) and polypeptides of the invention can be formulated and administered in any suitable manner known per se, for which reference is for example made to the general background art cited above (and in particular to WO 04/041862, WO 04/041863, WO 04/041865, WO 04/041867 and WO 08/020,079) as well as to the standard handbooks, such as Remington's Pharmaceutical Sciences, 18$^{th}$ Ed., Mack Publishing Company, USA (1990), Remington, the Science and Practice of Pharmacy, 21th Edition, Lippincott Williams and Wilkins (2005); or the Handbook of Therapeutic Antibodies (S. Dubel, Ed.), Wiley, Weinheim, 2007 (see for example pages 252-255). For example, the amino acid sequences, Nanobodies (or ISV's) and polypeptides of the invention may be formulated and administered in any manner known per se for conventional antibodies and antibody fragments (including ScFv's and diabodies) and other pharmaceutically active proteins. Such formulations and methods for preparing the same will be clear to the skilled person, and for example include preparations suitable for parenteral administration (for example intravenous, intraperitoneal, subcutaneous, intramuscular, intraluminal, intra-arterial or intrathecal administration) or for topical (i.e. transdermal or intradermal) administration. Preparations for parenteral administration may for example be sterile solutions, suspensions, dispersions or emulsions that are suitable for infusion or injection. Suitable carriers or diluents for such preparations for example include, without limitation, those mentioned on page 143 of WO 08/020,079. Usually, aqueous solutions or suspensions will be preferred. The amino acid sequences, Nanobodies (or ISV's) and polypeptides of the invention can also be administered using gene therapy methods of delivery. See, e.g., U.S. Pat. No. 5,399,346, which is incorporated by reference in its entirety. Using a gene therapy method of delivery, primary cells transfected with the gene encoding an amino acid sequence, Nanobody (or ISV) or polypeptide of the invention can additionally be transfected with tissue specific promoters to target specific organs, tissue, grafts, tumors, or cells and can additionally be transfected with signal and stabilization sequences for subcellularly localized expression. Thus, the amino acid sequences, Nanobodies (or ISV's) and polypeptides of the invention may be systemically administered, e.g., orally, in combination with a pharmaceutically acceptable vehicle such as an inert diluent or an assimilable edible carrier. They may be enclosed in hard or soft shell gelatin capsules, may be compressed into tablets, or may be incorporated directly with the food of the patient's diet. For oral therapeutic administration, the amino acid sequences, Nanobodies (or ISV's) and polypeptides of the invention may be combined with one or more excipients and used in the form of ingestible tablets, buccal tablets, troches, capsules, elixirs, suspensions, syrups, wafers, and the like. Such compositions and preparations should contain at least 0.1% of the amino acid sequence, Nanobody (or ISV) or polypeptide of the invention. Their percentage in the compositions and preparations may, of course, be varied and may conveniently be between about 2 to about 60% of the weight of a given unit dosage form. The amount of the amino acid sequence, Nanobody (or ISV) or polypeptide of the invention in such therapeutically useful compositions is such that an effective dosage level will be obtained.

The tablets, troches, pills, capsules, and the like may also contain binders, excipients, disintegrating agents, lubricants and sweetening or flavouring agents, for example those mentioned on pages 143-144 of WO 08/020,079. When the unit dosage form is a capsule, it may contain, in addition to materials of the above type, a liquid carrier, such as a vegetable oil or a polyethylene glycol. Various other materials may be present as coatings or to otherwise modify the physical form of the solid unit dosage form. For instance, tablets, pills, or capsules may be coated with gelatin, wax, shellac or sugar and the like. A syrup or elixir may contain the amino acid sequences, Nanobodies (or ISV's) and polypeptides of the invention, sucrose or fructose as a sweetening agent, methyl and propylparabens as preservatives, a dye and flavoring such as cherry or orange flavor. Of course, any material used in preparing any unit dosage form should be pharmaceutically acceptable and substantially non-toxic in the amounts employed. In addition, the amino acid sequences, Nanobodies (or ISV's) and polypeptides of the invention may be incorporated into sustained-release preparations and devices.

Preparations and formulations for oral administration may also be provided with an enteric coating that will allow the constructs of the invention to resist the gastric environment and pass into the intestines. More generally, preparations and formulations for oral administration may be suitably formulated for delivery into any desired part of the gastrointestinal tract. In addition, suitable suppositories may be used for delivery into the gastrointestinal tract. The amino acid sequences, Nanobodies (or ISV's) and polypeptides of the invention may also be administered intravenously or intraperitoneally by infusion or injection, as further described on pages 144 and 145 of WO 08/020,079. For topical administration, the amino acid sequences, Nanobodies (or ISV's) and polypeptides of the invention may be applied in pure form, i.e., when they are liquids. However, it will generally be desirable to administer them to the skin as compositions or formulations, in combination with a dermatologically acceptable carrier, which may be a solid or a liquid, as further described on page 145 of WO 08/020,079.

Generally, the concentration of the amino acid sequences, Nanobodies (or ISV's) and polypeptides of the invention in a liquid composition, such as a lotion, will be from about 0.1-25 wt-%, preferably from about 0.5-10 wt-%. The concentration in a semi-solid or solid composition such as a gel or a powder will be about 0.1-5 wt-%, preferably about 0.5-2.5 wt-%. The amount of the amino acid sequences, Nanobodies (or ISV's) and polypeptides of the invention required for use in treatment will vary not only with the particular amino acid sequence, Nanobody (or ISV) or polypeptide selected but also with the route of administration, the nature of the condition being treated and the age and condition of the patient and will be ultimately at the discretion of the attendant physician or clinician. Also the dosage of the amino acid sequences, Nanobodies (or ISV's) and polypeptides of the invention varies depending on the target cell, tumor, tissue, graft, or organ. The desired dose may conveniently be presented in a single dose or as divided doses administered at appropriate intervals, for example, as two, three, four or more sub-doses per day. The sub-dose itself may be further divided, e.g., into a number of discrete loosely spaced administrations; such as multiple inhalations from an insufflator or by application of a plurality of drops into the eye. An administration regimen could include long-term, daily treatment. By "long-term" is meant at least two weeks and preferably, several weeks, months, or years of duration. Necessary modifications in this dosage range may be determined by one of ordinary skill in the art using only routine experimentation given the teachings herein. See Remington's Pharmaceutical Sciences (Martin, E. W., ed. 4), Mack Publishing Co., Easton, Pa. The dosage can also be adjusted by the individual physician in the event of any complication.

In another aspect, the invention relates to a method for the prevention and/or treatment of at least one immune related diseases and disorders of the invention, said method comprising administering, to a subject in need thereof, a pharmaceutically active amount of an amino acid sequence of the invention, of a Nanobody (or ISV) of the invention, of a polypeptide of the invention, and/or of a pharmaceutical composition comprising the same. In the context of the present invention, the term "prevention and/or treatment" not only comprises preventing and/or treating the disease, but also generally comprises preventing the onset of the disease, slowing or reversing the progress of disease, preventing or slowing the onset of one or more symptoms associated with the disease, reducing and/or alleviating one or more symptoms associated with the disease, reducing the severity and/or the duration of the disease and/or of any symptoms associated therewith and/or preventing a further increase in the severity of the disease and/or of any symptoms associated therewith, preventing, reducing or reversing any physiological damage caused by the disease, and generally any pharmacological action that is beneficial to the patient being treated. The subject to be treated may be any warm-blooded animal, but is in particular a mammal, and more in particular a human being. As will be clear to the skilled person, the subject to be treated will in particular be a person suffering from, or at risk of, the diseases and disorders mentioned herein. The invention relates to a method for the prevention and/or treatment of at least one disease or disorder that is associated with any of IL-17A, IL-17F and/or IL-17A/F including combinations thereof, with its biological or pharmacological activity, and/or with the biological pathways or signalling in which any of IL-17A, IL-17F and/or IL-17A/F including combinations thereof is involved, said method comprising administering, to a subject in need thereof, a pharmaceutically active amount of an amino acid sequence of the invention, of a Nanobody (or ISV) of the invention, of a polypeptide of the invention, and/or of a pharmaceutical composition comprising the same. In particular, the invention relates to a method for the prevention and/or treatment of at least one disease or disorder that can be treated by modulating any of IL-17A, IL-17F and/or IL-17A/F including combinations thereof, its biological or pharmacological activity, and/or the biological pathways or signalling in which any of IL-17A, IL-17F and/or IL-17A/F including combinations thereof is involved, said method comprising administering, to a subject in need thereof, a pharmaceutically active amount of an amino acid sequence of the invention, of a Nanobody (or ISV) of the invention, of a polypeptide of the invention, and/or of a pharmaceutical composition comprising the same. In particular, said pharmaceutically effective amount may be an amount that is sufficient to modulate any of IL-17A, IL-17F and/or IL-17A/F including combinations thereof, its biological or pharmacological activity, and/or the biological pathways or signalling in which any of IL-17A, IL-17F and/or IL-17A/F including combinations thereof is involved; and/or an amount that provides a level of the amino acid sequence of the invention, of a Nanobody (or ISV) of the invention, of a polypeptide of the invention in the circulation that is sufficient to modulate any of IL-17A, IL-17F and/or IL-17A/F including combinations thereof, its biological or pharmacological activity, and/or the biological pathways or signalling in which any of IL-17A, IL-17F and/or IL-17A/F including combinations thereof is involved. The invention furthermore relates to a method for the prevention and/or treatment of at least one disease or disorder that can be prevented and/or treated by administering an amino acid sequence of the invention, a Nanobody (or ISV) of the invention or a polypeptide of the invention to a patient, said method comprising administering, to a subject in need thereof, a pharmaceutically active amount of an amino acid sequence of the invention, of a Nanobody (or ISV) of the invention, of a polypeptide of the invention, and/or of a pharmaceutical composition comprising the same. More in particular, the invention relates to a method for the prevention and/or treatment of at least one disease or disorder chosen from the group consisting of the diseases and disorders listed herein, said method comprising administering, to a subject in need thereof, a pharmaceutically active amount of an amino acid sequence of the invention, of a Nanobody (or ISV) of the invention, of a polypeptide of the invention, and/or of a pharmaceutical composition comprising the same. Examples of the immune related diseases and disorders of the invention will be clear to the skilled person based on the disclosure herein, and for example include the following diseases and disorders: systemic lupus erythematosis, rheumatoid arthritis, osteoarthritis, juvenile chronic arthritis, spondyloarthropathies, systemic sclerosis, idiopathic inflammatory myopathies, Sjögren's syndrome, systemic vasculitis, sarcoidosis, autoimmune hemolytic anemia, autoimmune thrombocytopenia, thyroiditis, diabetes mellitus, immune-mediated renal disease, demyelinating diseases of the central and peripheral nervous systems such as multiple sclerosis, idiopathic demyelinating polyneuropathy or Guillain Barre syndrome, and chronic inflammatory demyelinating polyneuropathy, hepatobiliary diseases such as infectious, autoimmune chronic active hepatitis, primary biliary cirrhosis, granulomatous hepatitis, and sclerosing cholangitis, inflammatory bowel disease, gluten-sensitive enteropathy, and Whipple's disease, autoimmune or immune-mediated skin diseases including bullous skin diseases, erythema multiforme and contact dermatitis, psoriasis, allergic diseases such as asthma, allergic rhinitis, atopic dermatitis, food hypersensitivity and urticaria, immunologic diseases of the lung such as eosinophilic pneumonia, idiopathic pulmonary fibrosis and hypersensitivity pneumonitis, transplantation associated diseases including graft rejection and graft-versus-host-disease.

In the above methods, the amino acid sequences, Nanobodies (or ISV's) and/or polypeptides of the invention and/or the compositions comprising the same can be administered in any suitable manner, depending on the specific pharmaceutical formulation or composition to be used. Thus, the amino acid sequences, Nanobodies (or ISV's) and/or polypeptides of the invention and/or the compositions comprising the same can for example be administered orally, intraperitoneally (e.g. intravenously, subcutaneously, intramuscularly, or via any other route of administration that circumvents the gastrointestinal tract), intranasally, transdermally, topically, by means of a suppository, by inhalation, again depending on the specific pharmaceutical formulation or composition to be used. The clinician will be able to select a suitable route of administration and a suitable pharmaceutical formulation or composition to be used in such administration, depending on the disease or disorder to be prevented or treated and other factors well known to the clinician.

The amino acid sequences, Nanobodies (or ISV's) and/or polypeptides of the invention and/or the compositions comprising the same are administered according to a regime of treatment that is suitable for preventing and/or treating the disease or disorder to be prevented or treated. The clinician will generally be able to determine a suitable treatment regimen, depending on factors such as the disease or disorder to be prevented or treated, the severity of the disease to be treated and/or the severity of the symptoms thereof, the specific amino acid sequence, Nanobody (or ISV) or polypeptide of the invention to be used, the specific route of administration and pharmaceutical formulation or composition to be used, the age, gender, weight, diet, general condition of the patient, and similar factors well known to the clinician.

Generally, the treatment regimen will comprise the administration of one or more amino acid sequences, Nanobodies (or ISV's) and/or polypeptides of the invention, or of one or more compositions comprising the same, in one or more pharmaceutically effective amounts or doses. The specific amount(s) or doses to administered can be determined by the clinician, again based on the factors cited above.

Generally, for the prevention and/or treatment of the diseases and disorders mentioned herein and depending on the specific disease or disorder to be treated, the potency of the specific amino acid sequence, Nanobody (or ISV) and polypeptide of the invention to be used, the specific route of administration and the specific pharmaceutical formulation or composition used, the amino acid sequences, Nanobodies (or ISV's) and polypeptides of the invention will generally be administered in an amount between 1 gram and 0.01 microgram per kg body weight per day, preferably between 0.1 gram and 0.1 microgram per kg body weight per day, such as about 1, 10, 100 or 1000 microgram per kg body weight per day, either continuously (e.g. by infusion), as a single daily dose or as multiple divided doses during the day. The clinician will generally be able to determine a suitable daily dose, depending on the factors mentioned herein. It will also be clear that in specific cases, the clinician may choose to deviate from these amounts, for example on the basis of the factors cited above and his expert judgment. Generally, some guidance on the amounts to be administered can be obtained from the amounts usually administered for comparable conventional antibodies or antibody fragments against the same target administered via essentially the same route, taking into account however differences in affinity/avidity, efficacy, biodistribution, half-life and similar factors well known to the skilled person.

Usually, in the above method, a single amino acid sequence, Nanobody (or ISV) or polypeptide of the invention will be used. It is however within the scope of the invention to use two or more amino acid sequences, Nanobodies (or ISV's) and/or polypeptides of the invention in combination.

The Nanobodies (or ISV's), amino acid sequences and polypeptides of the invention may also be used in combination with one or more further pharmaceutically active compounds or principles, i.e. as a combined treatment regimen, which may or may not lead to a synergistic effect. Again, the clinician will be able to select such further compounds or principles, as well as a suitable combined treatment regimen, based on the factors cited above and his expert judgement. In particular, the amino acid sequences, Nanobodies (or ISV's) and polypeptides of the invention may be used in combination with other pharmaceutically active compounds or principles that are or can be used for the prevention and/or treatment of the diseases and disorders cited herein, as a result of which a synergistic effect may or may not be obtained. Examples of such compounds and principles, as well as routes, methods and pharmaceutical formulations or compositions for administering them will be clear to the clinician.

When two or more substances or principles are to be used as part of a combined treatment regimen, they can be administered via the same route of administration or via different routes of administration, at essentially the same time or at different times (e.g. essentially simultaneously, consecutively, or according to an alternating regime). When the substances or principles are to be administered simultaneously via the same route of administration, they may be administered as different pharmaceutical formulations or compositions or part of a combined pharmaceutical formulation or composition, as will be clear to the skilled person.

Also, when two or more active substances or principles are to be used as part of a combined treatment regimen, each of the substances or principles may be administered in the same amount and according to the same regimen as used when the compound or principle is used on its own, and such combined use may or may not lead to a synergistic effect. However, when the combined use of the two or more active substances or principles leads to a synergistic effect, it may also be possible to reduce the amount of one, more or all of the substances or principles to be administered, while still achieving the desired therapeutic action. This may for example be useful for avoiding, limiting or reducing any unwanted side-effects that are associated with the use of one or more of the substances or principles when they are used in their usual amounts, while still obtaining the desired pharmaceutical or therapeutic effect.

The effectiveness of the treatment regimen used according to the invention may be determined and/or followed in any manner known per se for the disease or disorder involved, as will be clear to the clinician. The clinician will also be able, where appropriate and on a case-by-case basis, to change or modify a particular treatment regimen, so as to achieve the desired therapeutic effect, to avoid, limit or reduce unwanted side-effects, and/or to achieve an appropriate balance between achieving the desired therapeutic effect on the one hand and avoiding, limiting or reducing undesired side effects on the other hand. Generally, the treatment regimen will be followed until the desired therapeutic effect is achieved and/or for as long as the desired therapeutic effect is to be maintained. Again, this can be determined by the clinician.

In another aspect, the invention relates to the use of an amino acid sequence, Nanobody (or ISV) or polypeptide of the invention in the preparation of a pharmaceutical composition for prevention and/or treatment of at least one immune related diseases and disorders of the invention; and/or for use in one or more of the methods of treatment mentioned herein.

The subject to be treated may be any warm-blooded animal, but is in particular a mammal, and more in particular a human being. For instance, it has been found that most Nanobodies (or ISV's) primarily raised against human IL-17A, IL-17F and/or IL-17A/F (or combinations thereof) of the invention cross-react with marmoset IL-17A, IL-17F and/or IL-17A/F (or combinations thereof). As will be clear to the skilled person, the subject to be treated will in particular be a person suffering from, or at risk of, the diseases and disorders mentioned herein.

The invention also relates to the use of an amino acid sequence, Nanobody (or ISV) or polypeptide of the invention in the preparation of a pharmaceutical composition for the prevention and/or treatment of at least one disease or disorder that can be prevented and/or treated by administering an amino acid sequence, Nanobody (or ISV) or polypeptide of the invention to a patient.

More in particular, the invention relates to the use of an amino acid sequence, Nanobody (or ISV) or polypeptide of the invention in the preparation of a pharmaceutical composition for the prevention and/or treatment of immune related diseases and disorders of the invention, and in particular for the prevention and treatment of one or more of the diseases and disorders listed herein. Again, in such a pharmaceutical composition, the one or more amino acid sequences, Nanobodies (or ISV's) or polypeptides of the invention may also be suitably combined with one or more other active principles, such as those mentioned herein. Finally, although the use of the Nanobodies (or ISV's) of the invention (as defined herein) and of the polypeptides of the invention is much preferred, it will be clear that on the basis of the description herein, the skilled person will also be able to design and/or generate, in an analogous manner, other amino acid sequences and in particular (single) domain antibodies against any of IL-17A, IL-17F and/or IL-17A/F including combinations thereof, as well as polypeptides comprising such (single) domain antibodies. For example, it will also be clear to the skilled person that it may be possible to "graft" one or more of the CDR's mentioned above for the Nanobodies (or ISV's) of the invention onto such (single) domain antibodies or other protein scaffolds, including but not limited to human scaffolds or non-immunoglobulin scaffolds. Suitable scaffolds and techniques for such CDR grafting will be clear to the skilled person and are well known in the art, see for example those mentioned in WO 08/020,079. For example, techniques known per se for grafting mouse or rat CDR's onto human frameworks and scaffolds can be used in an analogous manner to provide chimeric proteins comprising one or more of the CDR's of the Nanobodies (or ISV's) of the invention and one or more human framework regions or sequences. It should also be noted that, when the Nanobodies (or ISV's) of the inventions contain one or more other CDR sequences than the preferred CDR sequences mentioned above, these CDR sequences can be obtained in any manner known per se, for example using one or more of the techniques described in WO 08/020,079.

Further uses of the amino acid sequences, Nanobodies (or ISV's), polypeptides, nucleic acids, genetic constructs and hosts and host cells of the invention will be clear to the skilled person based on the disclosure herein. For example, and without limitation, the amino acid sequences of the invention can be linked to a suitable carrier or solid support so as to provide a medium than can be used in a manner known per se to purify any of IL-17A, IL-17F and/or IL-17A/F including combinations thereof from compositions and preparations comprising the same. Derivatives of the amino acid sequences of the invention that comprise a suitable detectable label can also be used as markers to determine (qualitatively or quantitatively) the presence of any of IL-17A, IL-17F and/or IL-17A/F including combinations thereof in a composition or preparation or as a marker to selectively detect the presence of any of IL-17A, IL-17F and/or IL-17A/F including combinations thereof on the surface of a cell or tissue (for example, in combination with suitable cell sorting techniques).

Some very preferred aspects of the invention are:

An amino acid sequence that is directed against and/or that can specifically bind to any of human IL-17A, human IL-17F and/or human IL-17A/F including combinations thereof.

A respective amino acid sequence with a rate of dissociation ($k_{off}$ rate) between between $10^{-4}$ $s^{-1}$ and $10^{-6}$ $s^{-1}$.

A respective amino acid sequence with an affinity to human IL-17A, human IL-17F and/or human IL-17A/F including combinations thereof less than 1 nM.

A respective amino acid sequence that comprises an immunoglobulin fold.

A respective amino acid sequence that is an immunoglobulin sequence.

A respective amino acid sequence that essentially consists of a light chain variable domain sequence (e.g. a VL-sequence); or of a heavy chain variable domain sequence (e.g. a VH-sequence).

A respective amino acid sequence that essentially consists of a Nanobody.

A respective amino acid sequence that essentially consists of a polypeptide that has at least 80% amino acid identity with at least one of the amino acid sequences of SEQ ID NOs: 623 to 693, in which for the purposes of determining the degree of amino acid identity, the amino acid residues that form the CDR sequences are disregarded; and in which preferably one or more of the amino acid residues at positions 11, 37, 44, 45, 47, 83, 84, 103, 104 and 108 according to the Kabat numbering are chosen from the Hallmark residues mentioned in Table B-2.

A respective amino acid sequence that can specifically bind to human IL-17A.

A respective amino acid sequence according to any of the preceding claims that can specifically bind to human IL-17A and human IL-17A/F.

A respective amino acid sequence that can specifically bind to human IL-17F.

A respective amino acid sequence that can specifically bind to human IL-17A, IL-17F and IL-17A/F.

An amino acid sequence that is directed against and/or that can specifically bind to human IL-17 A and IL-17A/F (class 2), characterized in that the amino acid sequence binds to a L74A or a Y85A or a H54A IL-17A mutant with significantly reduced affinity as compared to binding to the wildtype IL-17A sequence.

An amino acid sequence that is directed against and/or that can specifically bind to human IL-17A, IL-17F and IL-17A/F (class 4), characterized in that the amino acid sequence binds to a L74A or a Y85A or a N88A IL-17A mutant with significantly reduced affinity as compared to binding to the wildtype IL-17A sequence.

An amino acid sequence that is directed against and/or that can specifically bind to human IL17F, characterized in that the amino acid sequence binds to a R47A or R73A or I86A or N89A IL-17F mutant with significantly reduced affinity as compared to binding to the wildtype IL-17F sequence.

A first amino acid sequence competing for binding to human IL-17A and/or IL-17 A/F with a second amino acid sequence, wherein that second amino acid sequence specifically binds to human IL-17 A and IL-17A/F (class 2), and wherein that second amino acid sequence binds to a L74A or a Y85A or a H54A IL-17A mutant with significantly reduced affinity as compared to binding to the wildtype IL-17A sequence, the first amino acid sequence not being IL-17A, IL-17 A/F and/or IL-17F.

A first amino acid sequence competing for binding to human IL-17A, IL-17 A/F and/or IL-17F with a second amino acid sequence, wherein that second amino acid sequence specifically binds to human IL-17A, IL-17F and IL-17A/F (class 4), and wherein that second amino acid sequence binds to a L74A or a Y85A or a N88A IL-17A mutant with significantly reduced affinity as compared to binding to the wildtype IL-17A sequence, the first amino acid sequence not being IL-17A, IL-17 A/F and/or IL-17F.

A first amino acid sequence competing for binding to human IL-17F with a second amino acid sequence, wherein that second amino acid sequence specifically bind to human IL 17F, and wherein that second amino acid sequence binds to a R47A or R73A or I86A or N89A IL-17F mutant with significantly reduced affinity as compared to binding to the wildtype IL-17F sequence, the first amino acid sequence not being IL-17A, IL-17 A/F and/or IL-17F.

A polypeptide comprising at least one amino acid sequence of the invention.

Use of an amino acid sequence and/or a polypeptide of the invention for the treatment of a disease.

Use of an amino acid sequence and/or a of the invention for the treatment of systemic lupus erythematosis, rheumatoid arthritis, osteoarthritis, juvenile chronic arthritis, spondyloarthropathies, systemic sclerosis, idiopathic inflammatory myopathies, Sjögren's syndrome, systemic vasculitis, sarcoidosis, autoimmune hemolytic anemia, autoimmune thrombocytopenia, thyroiditis, diabetes mellitus, immune-mediated renal disease, demyelinating diseases of the central and peripheral nervous systems such as multiple sclerosis, idiopathic demyelinating polyneuropathy or Guillain-Barre syndrome, and chronic inflammatory demyelinating polyneuropathy, hepatobiliary diseases such as infectious, autoimmune chronic active hepatitis, primary biliary cirrhosis, granulomatous hepatitis, and sclerosing cholangitis, inflammatory bowel disease, gluten-sensitive enteropathy, and Whipple's disease, autoimmune or immune-mediated skin diseases including bullous skin diseases, erythema multiforme and contact dermatitis, psoriasis, allergic diseases such as asthma, allergic rhinitis, atopic dermatitis, food hypersensitivity and urticaria, immunologic diseases of the lung such as eosinophilic pneumonia, idiopathic pulmonary fibrosis and hypersensitivity pneumonitis, transplantation associated diseases including graft rejection and graft-versus-host-disease; or a pharmaceutical composition comprising a polypeptide and/or a amino acid sequence of the invention and a pharmaceutically acceptable excipient for the treatment of systemic lupus erythematosis, rheumatoid arthritis, osteoarthritis, juvenile chronic arthritis, spondyloarthropathies, systemic sclerosis, idiopathic inflammatory myopathies, Sjögren's syndrome, systemic vasculitis, sarcoidosis, autoimmune hemolytic anemia, autoimmune thrombocytopenia, thyroiditis, diabetes mellitus, immune-mediated renal disease, demyelinating diseases of the central and peripheral nervous systems such as multiple sclerosis, idiopathic demyelinating polyneuropathy or Guillain-Barre syndrome, and chronic inflammatory demyelinating polyneuropathy, hepatobiliary diseases such as infectious, autoimmune chronic active hepatitis, primary biliary cirrhosis, granulomatous hepatitis, and sclerosing cholangitis, inflammatory bowel disease, gluten-sensitive enteropathy, and Whipple's disease, autoimmune or immune-mediated skin diseases including bullous skin diseases, erythema multiforme and contact dermatitis, psoriasis, allergic diseases such as asthma, allergic rhinitis, atopic dermatitis, food hypersensitivity and urticaria, immunologic diseases of the lung such as eosinophilic pneumonia, idiopathic pulmonary fibrosis and hypersensitivity pneumonitis, transplantation associated diseases including graft rejection and graft-versus-host-disease; or a method of treating a patient in need thereof by administering an effective amount of a polypeptide and/or amino acid sequence according to claims 1 to 13, wherein the method is suitable for the treatment of systemic lupus erythematosis, rheumatoid arthritis, osteoarthritis, juvenile chronic arthritis, spondyloarthropathies, systemic sclerosis, idiopathic inflammatory myopathies, Sjögren's syndrome, systemic vasculitis, sarcoidosis, autoimmune hemolytic anemia, autoimmune thrombocytopenia, thyroiditis, diabetes mellitus, immune-mediated renal disease, demyelinating diseases of the central and peripheral nervous systems such as multiple sclerosis, idiopathic demyelinating polyneuropathy or Guillain-Barre syndrome, and chronic inflammatory demyelinating polyneuropathy, hepatobiliary diseases such as infectious, autoimmune chronic active hepatitis, primary biliary cirrhosis, granulomatous hepatitis, and sclerosing cholangitis, inflammatory bowel disease, gluten-sensitive enteropathy, and Whipple's disease, autoimmune or immune-mediated skin diseases including bullous skin diseases, erythema multiforme and contact dermatitis, psoriasis, allergic diseases such as asthma, allergic rhinitis, atopic dermatitis, food hypersensitivity and urticaria, immunologic diseases of the lung such as eosinophilic pneumonia, idiopathic pulmonary fibrosis and hypersensitivity pneumonitis, transplantation associated diseases including graft rejection and graft-versus-host-disease.

A pharmaceutical composition comprising an amino acid sequence and/or a polypeptide of the invention and a pharmaceutically acceptable excipient Some preferred but non-limiting aspects of the invention are listed below. Other aspects and embodiments of the invention will be clear to the skilled person based on the disclosure herein.

Aspect A-1: An amino acid sequence that is directed against and/or that can specifically bind to any of IL-17A, IL-17F and/or IL-17A/F including combinations thereof, preferably said amino acid sequence functions as binding unit.

Aspect A-2: An amino acid sequence according to aspect A-1, that is in essentially isolated form.

Aspect A-3: An amino acid sequence according to aspect A-1 or A-2, for administration to a subject, wherein said amino acid sequence does not naturally occur in said subject.

Aspect A-4: An amino acid sequence that can specifically bind to any of IL-17A, IL-17F and/or IL-17A/F including combinations thereof with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter. Such an amino acid sequence may in particular be an amino acid sequence according to any of the preceding aspects.

Aspect A-5: An amino acid sequence that can specifically bind to any of IL-17A, IL-17F and/or IL-17A/F including combinations thereof with a rate of association ($k_{on}$-rate) of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$. Such an amino acid sequence may in particular be an amino acid sequence according to any of the preceding aspects.

Aspect A-6: An amino acid sequence that can specifically bind to any of IL-17A, IL-17F and/or IL-17A/F including combinations thereof with a rate of dissociation ($k_{off}$ rate) between 1 $s^{-1}$ and $10^{-6}$ $s^{-1}$, preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$. Such an amino acid sequence may in particular be an amino acid sequence according to any of the preceding aspects.

Aspect A-7: An amino acid sequence that can specifically bind to any of IL-17A, IL-17F and/or IL-17A/F including combinations thereof with an affinity less than 500 nM, preferably less than 200 nM, more preferably less than 10 nM, such as less than 500 pM. Such an amino acid sequence may in particular be an amino acid sequence according to any of the preceding aspects.

Aspect A-8: An amino acid sequence according to any of the preceding aspects, that essentially consists of a polypeptide that i) has at least 80% amino acid identity with at least one of the amino acid sequences of SEQ ID NOs: 623 to 693, in which for the purposes of determining the degree of amino acid identity, the amino acid residues that form the CDR sequences are disregarded;

and in which:

ii) preferably one or more of the amino acid residues at positions 11, 37, 44, 45, 47, 83, 84, 103, 104 and 108 according to the Kabat numbering are chosen from the Hallmark residues mentioned in Table B-2.

Aspect A-9: An amino acid sequence according to any of the preceding aspects, that essentially consists of a Nanobody that i) has at least 80% amino acid identity with at least one of the amino acid sequences of SEQ ID NOs: 623 to 693, in which for the purposes of determining the degree of amino acid identity, the amino acid residues that form the CDR sequences are disregarded;

and in which:

ii) preferably one or more of the amino acid residues at positions 11, 37, 44, 45, 47, 83, 84, 103, 104 and 108 according to the Kabat numbering are chosen from the Hallmark residues mentioned in Table B-2.

Aspect A-10: An amino acid sequence according to any of the preceding aspects, that in addition to the at least one binding site for binding against any of IL-17A, IL-17F and/or IL-17A/F including combinations thereof, contains one or more further binding sites for binding against other antigens, proteins or targets.

Aspect A-11: An amino acid sequence that is directed against and/or that can specifically bind to any of IL-17A.

Aspect A-12: An amino acid sequence that can specifically bind to any of IL-17A with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter. Such an amino acid sequence may in particular be an amino acid sequence according to any of the preceding aspects.

Aspect A-13: An amino acid sequence that can specifically bind to any of IL-17A with a rate of association ($k_{on}$-rate) of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$. Such an amino acid sequence may in particular be an amino acid sequence according to any of the preceding aspects.

Aspect A-14: An amino acid sequence that can specifically bind to any of IL-17A with a rate of dissociation ($k_{off}$ rate) between 1 $s^{-1}$ and $10^{-6}$ $s^{-1}$, preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$. Such an amino acid sequence may in particular be an amino acid sequence according to any of the preceding aspects.

Aspect A-15: An amino acid sequence that can specifically bind to any of IL-17A with an affinity less than 500 nM, preferably less than 200 nM, more preferably less than 10 nM, such as less than 500 pM. Such an amino acid sequence may in particular be an amino acid sequence according to any of the preceding aspects.

Aspect A-16: An amino acid sequence according to any of the preceding aspects, that essentially consists of a polypeptide that (i) has at least 80% amino acid identity with at least one of the amino acid sequences of SEQ ID NOs: 623 to 627, in which for the purposes of determining the degree of amino acid identity, the amino acid residues that form the CDR sequences are disregarded;

and in which:

(ii) preferably one or more of the amino acid residues at positions 11, 37, 44, 45, 47, 83, 84, 103, 104 and 108 according to the Kabat numbering are chosen from the Hallmark residues mentioned in Table B-2.

Aspect A-17: An amino acid sequence according to any of the preceding aspects, that essentially consists of a Nanobody that
(i) has at least 80% amino acid identity with at least one of the amino acid sequences of SEQ ID NOs: 623 to 627, in which for the purposes of determining the degree of amino acid identity, the amino acid residues that form the CDR sequences are disregarded;
and in which:
(ii) preferably one or more of the amino acid residues at positions 11, 37, 44, 45, 47, 83, 84, 103, 104 and 108 according to the Kabat numbering are chosen from the Hallmark residues mentioned in Table B-2.

Aspect A-18: An amino acid sequence that is directed against and/or that can specifically bind to any of IL-17A and IL-17A/F.

Aspect A-19: An amino acid sequence that can specifically bind to IL-17A and IL-17A/F with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter. Such an amino acid sequence may in particular be an amino acid sequence according to any of the preceding aspects.

Aspect A-20: An amino acid sequence that can specifically bind to IL-17A and IL-17A/F with a rate of association ($k_{on}$-rate) of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$. Such an amino acid sequence may in particular be an amino acid sequence according to any of the preceding aspects.

Aspect A-21: An amino acid sequence that can specifically bind to EL-17A and IL-17A/F with a rate of dissociation ($k_{off}$ rate) between 1 $s^{-1}$ and $10^{-6}$ $s^{-1}$, preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$. Such an amino acid sequence may in particular be an amino acid sequence according to any of the preceding aspects.

Aspect A-22: An amino acid sequence that can specifically bind to IL-17A and IL-17A/F with an affinity less than 500 nM, preferably less than 200 nM, more preferably less than 10 nM, such as less than 500 pM. Such an amino acid sequence may in particular be an amino acid sequence according to any of the preceding aspects.

Aspect A-23: An amino acid sequence according to any of the preceding aspects, that essentially consists of a polypeptide that
(i) has at least 80% amino acid identity with at least one of the amino acid sequences of SEQ ID NOs: 628 to 639, in which for the purposes of determining the degree of amino acid identity, the amino acid residues that form the CDR sequences are disregarded;
and in which:
(ii) preferably one or more of the amino acid residues at positions 11, 37, 44, 45, 47, 83, 84, 103, 104 and 108 according to the Kabat numbering are chosen from the Hallmark residues mentioned in Table B-2.

Aspect A-24: An amino acid sequence according to any of the preceding aspects, that essentially consists of a Nanobody that
(i) has at least 80% amino acid identity with at least one of the amino acid sequences of SEQ ID NOs: 628 to 339, in which for the purposes of determining the degree of amino acid identity, the amino acid residues that form the CDR sequences are disregarded;
and in which:
(ii) preferably one or more of the amino acid residues at positions 11, 37, 44, 45, 47, 83, 84, 103, 104 and 108 according to the Kabat numbering are chosen from the Hallmark residues mentioned in Table B-2.

Aspect A-25: An amino acid sequence according to any of the preceding aspects, that in addition to the at least one binding site for binding against IL-17A and IL-17A/F, contains one or more further binding sites for binding against other antigens, proteins or targets.

Aspect A-26: An amino acid sequence that is directed against and/or that can specifically bind to IL-17F.

Aspect A-27: An amino acid sequence that can specifically bind to IL-17F with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter. Such an amino acid sequence may in particular be an amino acid sequence according to any of the preceding aspects.

Aspect A-28: An amino acid sequence that can specifically bind to IL-17F with a rate of association ($k_{on}$-rate) of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$. Such an amino acid sequence may in particular be an amino acid sequence according to any of the preceding aspects.

Aspect A-29: An amino acid sequence that can specifically bind to IL-17F with a rate of dissociation ($k_{off}$ rate) between 1 $s^{-1}$ and $10^{-6}$ $s^{-1}$, preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$. Such an amino acid sequence may in particular be an amino acid sequence according to any of the preceding aspects.

Aspect A-30: An amino acid sequence that can specifically bind to IL-17F with an affinity less than 500 nM, preferably less than 200 nM, more preferably less than 10 nM, such as less than 500 pM. Such an amino acid sequence may in particular be an amino acid sequence according to any of the preceding aspects.

Aspect A-31: An amino acid sequence according to any of the preceding aspects, that essentially consists of a polypeptide that
(i) has at least 80% amino acid identity with at least one of the amino acid sequences of SEQ ID NOs: 640 to 649, in which for the purposes of determining the degree of amino acid identity, the amino acid residues that form the CDR sequences are disregarded;
and in which:
(ii) preferably one or more of the amino acid residues at positions 11, 37, 44, 45, 47, 83, 84, 103, 104 and 108 according to the Kabat numbering are chosen from the Hallmark residues mentioned in Table B-2.

Aspect A-32: An amino acid sequence according to any of the preceding aspects, that essentially consists of a Nanobody that
(i) has at least 80% amino acid identity with at least one of the amino acid sequences of SEQ ID NOs: 640 to 649, in which for the purposes of determining the degree of amino acid identity, the amino acid residues that form the CDR sequences are disregarded;
and in which:
(ii) preferably one or more of the amino acid residues at positions 11, 37, 44, 45, 47, 83, 84, 103, 104 and 108 according to the Kabat numbering are chosen from the Hallmark residues mentioned in Table B-2.

Aspect A-33: An amino acid sequence according to any of the preceding aspects, that in addition to the at least one binding site for binding against IL-17F, contains one or more further binding sites for binding against other antigens, proteins or targets.

Aspect A-34: An amino acid sequence that is directed against and/or that can specifically bind to IL-17A, IL-17F and IL-17A/F.

Aspect A-35: An amino acid sequence that can specifically bind to IL-17A, IL-17F and IL-17A/F with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter. Such an amino acid sequence may in particular be an amino acid sequence according to any of the preceding aspects.

Aspect A-36: An amino acid sequence that can specifically bind to IL-17A, IL-17F and IL-17A/F with a rate of association ($k_{on}$-rate) of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$. Such an amino acid sequence may in particular be an amino acid sequence according to any of the preceding aspects.

Aspect A-37: An amino acid sequence that can specifically bind to IL-17A, IL-17F and IL-17A/F with a rate of dissociation ($k_w$ rate) between 1 $s^{-1}$ and $10^{-6}$ $s^{-1}$, preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$. Such an amino acid sequence may in particular be an amino acid sequence according to any of the preceding aspects.

Aspect A-38: An amino acid sequence that can specifically bind to IL-17A, IL-17F and IL-17A/F with an affinity less than 500 nM, preferably less than 200 nM, more preferably less than 10 nM, such as less than 500 pM. Such an amino acid sequence may in particular be an amino acid sequence according to any of the preceding aspects.

Aspect A-39: An amino acid sequence according to any of the preceding aspects, that is a naturally occurring amino acid sequence (from any suitable species, in particular mammal such as human or marmoset) or a synthetic or semi-synthetic amino acid sequence.

Aspect A-40: An amino acid sequence according to any of the preceding aspects, that comprises an immunoglobulin fold or that under suitable conditions is capable of forming an immunoglobulin fold.

Aspect A-41: An amino acid sequence according to any of the preceding aspects, that essentially consists of 4 framework regions (FR1 to FR4 respectively) and 3 complementarity determining regions (CDR1 to CDR3 respectively).

Aspect A-42: An amino acid sequence according to any of the preceding aspects, that is an immunoglobulin sequence.

Aspect A-43: An amino acid sequence according to any of the preceding aspects, that is a naturally occurring immunoglobulin sequence (from any suitable species) or a synthetic or semi-synthetic immunoglobulin sequence.

Aspect A-44: An amino acid sequence according to any of the preceding aspects that is a humanized immunoglobulin sequence, a camelized immunoglobulin sequence or an immunoglobulin sequence that has been obtained by techniques such as affinity maturation.

Aspect A-45: An amino acid sequence according to any of the preceding aspects, that essentially consists of a light chain variable domain sequence (e.g. a VL-sequence); or of a heavy chain variable domain sequence (e.g. a VH-sequence).

Aspect A-46: An amino acid sequence according to any of the preceding aspects, that essentially consists of a heavy chain variable domain sequence that is derived from a conventional four-chain antibody or that essentially consist of a heavy chain variable domain sequence that is derived from heavy chain antibody.

Aspect A-47: An amino acid sequence according to any of the preceding aspects, that essentially consists of a domain antibody (or an An amino acid sequence that is suitable for use as a domain antibody), of a single domain antibody (or an An amino acid sequence that is suitable for use as a single domain antibody), of a "dAb" (or an An amino acid sequence that is suitable for use as a dAb) or of a Nanobody (including but not limited to a VHH sequence).

Aspect A-48: An amino acid sequence according to any of the preceding aspects, that essentially consists of a Nanobody.

Aspect A-49: An amino acid sequence according to any of the preceding aspects, that essentially consists of a Nanobody that i) has at least 80% amino acid identity with at least one of the An amino acid sequences of SEQ ID NOs: 1 to 22, in which for the purposes of determining the degree of amino acid identity, the amino acid residues that form the CDR sequences are disregarded;

and in which:

ii) preferably one or more of the amino acid residues at positions 11, 37, 44, 45, 47, 83, 84, 103, 104 and 108 according to the Kabat numbering are chosen from the Hallmark residues mentioned in Table B-2.

Aspect A-50: An amino acid sequence according to any of the preceding aspects, that essentially consists of a polypeptide that (i) has at least 80% amino acid identity with at least one of the amino acid sequences of SEQ ID NOs: 650 to 693, in which for the purposes of determining the degree of amino acid identity, the amino acid residues that form the CDR sequences are disregarded;

and in which:

(ii) preferably one or more of the amino acid residues at positions 11, 37, 44, 45, 47, 83, 84, 103, 104 and 108 according to the Kabat numbering are chosen from the Hallmark residues mentioned in Table B-2.

Aspect A-51: An amino acid sequence according to any of the preceding aspects, that essentially consists of a Nanobody that (i) has at least 80% amino acid identity with at least one of the amino acid sequences of SEQ ID NOs: 650 to 693, in which for the purposes of determining the degree of amino acid identity, the amino acid residues that form the CDR sequences are disregarded;

and in which:

(ii) preferably one or more of the amino acid residues at positions 11, 37, 44, 45, 47, 83, 84, 103, 104 and 108 according to the Kabat numbering are chosen from the Hallmark residues mentioned in Table B-2.

Aspect A-52: An amino acid sequence according to any of the preceding aspects, that essentially consists of a humanized Nanobody.

Aspect A-53: An amino acid sequence according to any of the preceding aspects, that in addition to the at least one binding site for binding against IL-17A, IL-17F and IL-17A/F contains one or more further binding sites for binding against other antigens, proteins or targets.

Aspect A-54: An amino acid sequence according to each and any of the preceding aspects A-1 to A-53, in which said amino acid sequence is an ISV (as defined herein) and functions as a binding unit.

CDR-Based Aspects

Aspect B-1: An amino acid sequence that is directed against and/or that can specifically bind (e.g. a binding unit) any of IL-17A, IL-17F and/or IL-17A/F including combinations thereof, and that comprises one or more stretches of amino acid residues chosen from the group consisting of:
- a) the amino acid sequences of SEQ ID NOs: 197 to 267;
- b) amino acid sequences that have at least 80% amino acid identity with at least one of the amino acid sequences of SEQ ID NOs: 197 to 267;
- c) amino acid sequences that have 3, 2, or 1 amino acid difference with at least one of the amino acid sequences of SEQ ID NOs: 197 to 267;
- d) the amino acid sequences of SEQ ID NOs: 339 to 409;
- e) amino acid sequences that have at least 80% amino acid identity with at least one of the amino acid sequences of SEQ ID NOs: 339 to 409;
- f) amino acid sequences that have 3, 2, or 1 amino acid difference with at least one of the amino acid sequences of SEQ ID NOs: 339 to 409;
- g) the amino acid sequences of SEQ ID NOs: 481 to 551;
- h) amino acid sequences that have at least 80% amino acid identity with at least one of the amino acid sequences of SEQ ID NOs: 481 to 551;
- i) amino acid sequences that have 3, 2, or 1 amino acid difference with at least one of the amino acid sequences of SEQ ID NOs: 481 to 551;

or any suitable combination thereof.

Such an amino acid sequence may in particular be an amino acid sequence according to any of the aspects A-1 to A-54.

Aspect B-2: An amino acid sequence according to aspect B-1, in which at least one of said stretches of amino acid residues forms part of the antigen binding site for binding against any of IL-17A, IL-17F and/or IL-17A/F including combinations thereof.

Aspect B-3: An amino acid sequence sequence that is directed against and/or that can specifically bind any of IL-17A, IL-17F and/or IL-17A/F including combinations thereof and that comprises two or more stretches of amino acid residues chosen from the group consisting of:
- a) the amino acid sequences of SEQ ID NOs: 197 to 267;
- b) amino acid sequences that have at least 80% amino acid identity with at least one of the amino acid sequences of SEQ ID NOs: 197 to 267;
- c) amino acid sequences that have 3, 2, or 1 amino acid difference with at least one of the amino acid sequences of SEQ ID NOs: 197 to 267;
- d) the amino acid sequences of SEQ ID NOs: 339 to 409;
- e) amino acid sequences that have at least 80% amino acid identity with at least one of the amino acid sequences of SEQ ID NOs: 339 to 409;
- f) amino acid sequences that have 3, 2, or 1 amino acid difference with at least one of the amino acid sequences of SEQ ID NOs: 339 to 409;
- g) the amino acid sequences of SEQ ID NOs: 481 to 551;
- h) amino acid sequences that have at least 80% amino acid identity with at least one of the amino acid sequences of SEQ ID NOs: 481 to 551;
- i) amino acid sequences that have 3, 2, or 1 amino acid difference with at least one of the amino acid sequences of SEQ ID NOs: 481 to 551;

such that (i) when the first stretch of amino acid residues corresponds to one of the amino acid sequences according to a), b) or c), the second stretch of amino acid residues corresponds to one of the amino acid sequences according to d), e), f), g), h) or i); (ii) when the first stretch of amino acid residues corresponds to one of the amino acid sequences according to d), e) or f), the second stretch of amino acid residues corresponds to one of the amino acid sequences according to a), b), c), g), h) or i); or (iii) when the first stretch of amino acid residues corresponds to one of the amino acid sequences according to g), h) or i), the second stretch of amino acid residues corresponds to one of the amino acid sequences according to a), b), c), d), e) or f).

Such an amino acid sequence may in particular be an amino acid sequence according to any of the aspects A-1 to A-54, B-1 or B-2.

Aspect B-4: An amino acid sequence according to aspect B-3, in which the at least two stretches of amino acid residues forms part of the antigen binding site for binding against any of IL-17A, IL-17F and/or IL-17A/F including combinations thereof.

Aspect B-5: An amino acid sequence sequence that is directed against and/or that can specifically bind any of IL-17A, IL-17F and/or IL-17A/F including combinations thereof and that comprises three or more stretches of amino acid residues, in which the first stretch of amino acid residues is chosen from the group consisting of:
- a) the amino acid sequences of SEQ ID NOs: 197 to 267;
- b) amino acid sequences that have at least 80% amino acid identity with at least one of the amino acid sequences of SEQ ID NOs: 197 to 267;
- c) amino acid sequences that have 3, 2, or 1 amino acid difference with at least one of the amino acid sequences of SEQ ID NOs: 197 to 267;

the second stretch of amino acid residues is chosen from the group consisting of:
- d) the amino acid sequences of SEQ ID NOs: 339 to 409;
- e) amino acid sequences that have at least 80% amino acid identity with at least one of the amino acid sequences of SEQ ID NOs: 339 to 409;
- f) amino acid sequences that have 3, 2, or 1 amino acid difference with at least one of the amino acid sequences of SEQ ID NOs: 339 to 409;

and the third stretch of amino acid residues is chosen from the group consisting of:
- g) the amino acid sequences of SEQ ID NOs: 481 to 551;
- h) amino acid sequences that have at least 80% amino acid identity with at least one of the amino acid sequences of SEQ ID NOs: 481 to 551;
- i) amino acid sequences that have 3, 2, or 1 amino acid difference with at least one of the amino acid sequences of SEQ ID NOs: 481 to 551.

Such an amino acid sequence may in particular be an amino acid sequence according to any of the aspects A-1 to A-54 and/or B-1 to B-4.

Aspect B-6: An amino acid sequence according to aspect B-5, in which the at least three stretches of amino acid residues forms part of the antigen binding site for binding against any of IL-17A, IL-17F and/or IL-17A/F including combinations thereof.

Aspect B-7: An amino acid sequence that is directed against and/or that can specifically bind any of IL-17A, IL-17F and/or IL-17A/F including combinations thereof in which the CDR sequences of said amino acid sequence have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NOs: 623 to 693. Such an amino acid sequence may in particular be an amino acid sequence according to any of the aspects A-1 to A-54 and/or B-1 to B-6.

Aspect B-8: An amino acid sequence according to each and any of the preceding aspects B-1 to B-7, in which said amino acid sequence is an ISV (as defined herein).

Aspect C-1: An amino acid sequence that is directed against any of IL-17A, IL-17F and/or IL-17A/F including combinations thereof and that cross-blocks the binding (e.g. a binding unit) of at least one of the amino acid sequences of SEQ ID NOs: 623 to 693 to any of IL-17A, IL-17F and/or IL-17A/F including combinations thereof. Such an amino acid sequence may in particular be an amino acid sequence according to any of the aspects A-1 to A-54 and/or according to aspects B-1 to B-8. Also, preferably, such an amino acid sequence is able to specifically bind to any of IL-17A, IL-17F and/or IL-17A/F including combinations thereof.

Aspect C-2: An amino acid sequence that is directed against any of IL-17A, IL-17F and/or IL-17A/F including combinations thereof and that is cross-blocked from binding to any of IL-17A, IL-17F and/or IL-17A/F including combinations thereof by at least one of the amino acid sequences of SEQ ID NOs: 623 to 693. Such an amino acid sequence may in particular be an amino acid sequence according to any of the aspects A-1 to A-54 and/or according to aspects B-1 to B-8. Also, preferably, such an amino acid sequence is able to specifically bind to any of IL-17A, IL-17F and/or IL-17A/F including combinations thereof.

Aspect C-3: An amino acid sequence according to any of aspects C-1 or C-2, wherein the ability of said amino acid sequence to cross-block or to be cross-blocked is detected in a Biacore assay.

Aspect C-4: An amino acid sequence according to any of aspects C-1 to C-3 wherein the ability of said amino acid sequence to cross-block or to be cross-blocked is detected in an ELISA assay.

Aspect C-5: An amino acid sequence according to each and any of the preceding aspects C-1 to C-4, in which said amino acid sequence is an ISV (as defined herein), and preferably functions as a binding unit.

Aspect D-1: An amino acid sequence according to any of aspects B-1 to B-8 or C-1 to C-5, that is in essentially isolated form.

Aspect D-2: An amino acid sequence according to any of aspects B-1 to B-8, C-1 to C-5, and/or D1 for administration to a subject, wherein said amino acid sequence does not naturally occur in said subject.

Aspect D-3: An amino acid sequence according to any of aspects B-1 to B-8, C-1 to C-5, and/or D1 to D-2 that can specifically bind to any of IL-17A, IL-17F and/or IL-17A/F including combinations thereof with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter.

Aspect D-4: An amino acid sequence according to any of aspects B-1 to B-8, C-1 to C-5, and/or D-1 to D-3 that can specifically bind to any of IL-17A, IL-17F and/or IL-17A/F including combinations thereof with a rate of association ($k_{on}$-rate) of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$.

Aspect D-5: An amino acid sequence according to any of aspects B-1 to B-8, C-1 to C-5, and/or D-1 to D-4 that can specifically bind to any of IL-17A, IL-17F and/or IL-17A/F including combinations thereof with a rate of dissociation ($k_{off}$ rate) between 1 $s^{-1}$ and $10^{-6}$ $s^{-1}$ preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Aspect D-6: An amino acid sequence according to any of aspects B-1 to B-8, C-1 to C-5, and/or D-1 to D-5 that can specifically bind to any of IL-17A, IL-17F and/or IL-17A/F including combinations thereof with an affinity less than 500 nM, preferably less than 200 nM, more preferably less than 10 nM, such as less than 500 pM.

Aspect D-7: An amino acid sequence according to each and any of the preceding aspects D-1 to D-6, in which said amino acid sequence is an ISV (as defined herein), and preferably functions as a binding unit.

The amino acid sequences according to aspects D-1 to D-7 may in particular be an amino acid sequence according to any of the aspects A-1 to A-54.

Aspect E-1: An amino acid sequence according to any of aspects B-1 to B-8, C-1 to C-5 and/or D1 to D-7, that is a naturally occurring amino acid sequence (from any suitable species) or a synthetic or semi-synthetic amino acid sequence.

Aspect E-2: An amino acid sequence according to any of aspects B-1 to B-8, C-1 to C-5, D1 to D-7, and/or E-1 that comprises an immunoglobulin fold or that under suitable conditions is capable of forming an immunoglobulin fold.

Aspect E-3: An amino acid sequence according to any of aspects B-1 to B-8, C-1 to C-5, D1 to D-7, and/or E-1 or E-2, that is an immunoglobulin sequence.

Aspect E-4: An amino acid sequence according to any of aspects B-1 to B-8, C-1 to C-5, D1 to D-7, and/or E-1 to E-3, that is a naturally occurring immunoglobulin sequence (from any suitable species) or a synthetic or semi-synthetic immunoglobulin sequence.

Aspect E-5: An amino acid sequence according to any of aspects B-1 to B-8, C-1 to C-5, D1 to D-7, and/or E-1 to E-4 that is a humanized immunoglobulin sequence, a camelized immunoglobulin sequence or an immunoglobulin sequence that has been obtained by techniques such as affinity maturation.

Aspect E-6: An amino acid sequence according to any of aspects B-1 to B-8, C-1 to C-5, D1 to D-7, and/or E-1 to E-5 that essentially consists of a light chain variable domain sequence (e.g. a $V_L$-sequence); or of a heavy chain variable domain sequence (e.g. a $V_H$-sequence).

Aspect E-7: An amino acid sequence according to any of aspects B-1 to B-8, C-1 to C-5, D1 to D-7, and/or E-1 to E-6, that essentially consists of a heavy chain variable domain sequence that is derived from a conventional four-chain antibody or that essentially consist of a heavy chain variable domain sequence that is derived from heavy chain antibody.

Aspect E-8: An amino acid sequence according to any of aspects B-1 to B-8, C-1 to C-5, D1 to D-7, and/or E-1 to E-7, that essentially consists of a domain antibody (or an An amino acid sequence that is suitable for use as a domain antibody), of a single domain antibody (or an An amino acid sequence that is suitable for use as a single domain antibody), of a "dAb" (or an An amino acid sequence that is suitable for use as a dAb) or of a Nanobody (including but not limited to a $V_{HH}$ sequence).

Aspect E-9: An amino acid sequence according to any of aspects B-1 to B-8, C-1 to C-5, D1 to D-7, and/or E-1 to E-8 that essentially consists of a Nanobody.

Aspect E-10: An amino acid sequence according to any of aspects B-1 to B-8, C-1 to C-5, D1 to D-7, and/or E-1 to E-9 that essentially consists of a Nanobody that i) has at least 80% amino acid identity with at least one of the amino acid sequences of SEQ ID NOs: 1 to 22, in which for the purposes of determining the degree of amino acid identity, the amino acid residues that form the CDR sequences are disregarded;

and in which:

ii) preferably one or more of the amino acid residues at positions 11, 37, 44, 45, 47, 83, 84, 103, 104 and 108 according to the Kabat numbering are chosen from the Hallmark residues mentioned in Table B-2.

Aspect E-11: An amino acid sequence according to any of aspects B-1 to B-8, C-1 to C-5, D1 to D-7, and/or E-1 to E-10, that essentially consists of a Nanobody that i) has at least 80% amino acid identity with at least one of the An amino acid sequences of SEQ ID NOs: 623 to 693, in which for the purposes of determining the degree of amino acid identity, the amino acid residues that form the CDR sequences are disregarded;

and in which:

ii) preferably one or more of the amino acid residues at positions 11, 37, 44, 45, 47, 83, 84, 103, 104 and 108 according to the Kabat numbering are chosen from the Hallmark residues mentioned in Table B-2.

Aspect E-12: An amino acid sequence according to any of aspects B-1 to B-8, C-1 to C-5, D1 to D-7, and/or E-1 to E-11 that essentially consists of a humanized Nanobody.

Aspect E-13: An amino acid sequence according to any of the aspects B-1 to B-8, C-1 to C-5, D1 to D-7, and/or E-1 to E-11, that in addition to the at least one binding site for binding formed by the CDR sequences, contains one or more further binding sites for binding against other antigens, proteins or targets.

Aspect E-14: An amino acid sequence according to each and any of the preceding aspects E-1 to E-13, in which said amino acid sequence is an ISV (as defined herein), and preferably functions as a binding unit.

The amino acid sequences according to aspects E-1 to E-14 may in particular be an amino acid sequence according to any of the aspects A-1 to A-54.

Framework+CDR's Aspects

Aspect F-1: An amino acid sequence that essentially consists of 4 framework regions (FR1 to FR4, respectively) and 3 complementarity determining regions (CDR1 to CDR3, respectively), in which:

CDR1 is chosen from the group consisting of:

a) the amino acid sequences of SEQ ID NOs: 197 to 267;
b) amino acid sequences that have at least 80% amino acid identity with at least one of the amino acid sequences of SEQ ID NOs: 197 to 267;
c) amino acid sequences that have 3, 2, or 1 amino acid difference with at least one of the amino acid sequences of SEQ ID NOs: 197 to 267;

and/or

CDR2 is chosen from the group consisting of:

d) the amino acid sequences of SEQ ID NOs: 339 to 409;
e) amino acid sequences that have at least 80% amino acid identity with at least one of the amino acid sequences of SEQ ID NOs: 339 to 409;
f) amino acid sequences that have 3, 2, or 1 amino acid difference with at least one of the amino acid sequences of SEQ ID NOs: 339 to 409;

and/or

CDR3 is chosen from the group consisting of:

g) the amino acid sequences of SEQ ID NOs: 481 to 551;
h) amino acid sequences that have at least 80% amino acid identity with at least one of the amino acid sequences of SEQ ID NOs: 481 to 551;
i) amino acid sequences that have 3, 2, or 1 amino acid difference with at least one of the amino acid sequences of SEQ ID NOs: 481 to 551.

Such an amino acid sequence is preferably directed against any of IL-17A, IL-17F and/or IL-17A/F including combinations thereof and/or an amino acid sequence that can specifically bind (e.g. as a binding unit) to any of IL-17A, IL-17F and/or IL-17A/F including combinations thereof. Also, such an amino acid sequence is preferably an amino acid sequence according to any of the aspects A-1 to A-54, C-1 to C-5, D1 to D-7 and/or E-1 to E-14.

Aspect F-2: An amino acid sequence that essentially consists of 4 framework regions (FR1 to FR4, respectively) and 3 complementarity determining regions (CDR1 to CDR3, respectively), in which:

CDR1 is chosen from the group consisting of:

a) the amino acid sequences of SEQ ID NOs: 197 to 267;
b) amino acid sequences that have at least 80% amino acid identity with at least one of the amino acid sequences of SEQ ID NOs: 197 to 267;
c) amino acid sequences that have 3, 2, or 1 amino acid difference with at least one of the amino acid sequences of SEQ ID NOs: 197 to 267;

and

CDR2 is chosen from the group consisting of:

d) the amino acid sequences of SEQ ID NOs: 339 to 409;
e) amino acid sequences that have at least 80% amino acid identity with at least one of the amino acid sequences of SEQ ID NOs: 339 to 409;
f) amino acid sequences that have 3, 2, or 1 amino acid difference with at least one of the amino acid sequences of SEQ ID NOs: 339 to 409;

and

CDR3 is chosen from the group consisting of:

g) the amino acid sequences of SEQ ID NOs: 481 to 551;
h) amino acid sequences that have at least 80% amino acid identity with at least one of the amino acid sequences of SEQ ID NOs: 481 to 551;
i) amino acid sequences that have 3, 2, or 1 amino acid difference with at least one of the amino acid sequences of SEQ ID NOs: 481 to 551.

Such an amino acid sequence is preferably directed against any of IL-17A, IL-17F and/or IL-17A/F including combinations thereof and/or an amino acid sequence that can specifically bind (e.g. as a binding unit) to any of IL-17A, IL-17F and/or IL-17A/F including combinations thereof. Also, such an amino acid sequence is preferably an amino acid sequence according to any of the aspects A-1 to A-54, C-1 to C-5, D1 to D-7 and/or E-1 to E-14.

Aspect F-3: An amino acid sequence according to any of aspects F-1 and F-2, in which the CDR sequences of said amino acid sequence have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NOs: 623 to 693.

Such an amino acid sequence is preferably directed against any of IL-17A, IL-17F and/or IL-17A/F including combinations thereof and/or an amino acid sequence that can specifically bind to any of IL-17A, IL-17F and/or IL-17A/F including combinations thereof. Also, such an amino acid sequence is preferably an amino acid sequence according to any of the aspects A-1 to A-54, C-1 to C-5, D1 to D-7 and/or E-1 to E-14.

Aspect F-4: An amino acid sequence according to any of aspects F-1 to F-3 that is directed against any of IL-17A, IL-17F and/or IL-17A/F including combinations thereof and that cross-blocks the binding of at least one of the amino acid sequences according to any of aspects the amino acid sequences of SEQ ID NOs: 623 to 693.

Aspect F-5: An amino acid sequence according to any of aspects F-1 to F-3 that is directed against any of IL-17A, IL-17F and/or IL-17A/F including combinations thereof and that is cross-blocked from binding to any of IL-17A, IL-17F and/or IL-17A/F including combinations thereof by at least one of the amino acid sequences of SEQ ID NOs: 623 to 693.

Aspect F-6: Amino acid sequence according to any of aspects F-4 or F-5 wherein the ability of said amino acid sequence to cross-block or to be cross-blocked is detected in a Biacore assay.

Aspect F-7: Amino acid sequence according to any of aspects F4 or F-5 wherein the ability of said amino acid sequence to cross-block or to be cross-blocked is detected in an ELISA assay.

Aspect F-8: An amino acid sequence according to any of aspects F-1 to F-7, that is in essentially isolated form.

Aspect F-9: An amino acid sequence according to any of aspects F-1 to F-8, for administration to a subject, wherein said an amino acid sequence does not naturally occur in said subject.

Aspect F-10: An amino acid sequence according to any of aspects F-1 to F-9, that can specifically bind to any of IL-17A, IL-17F and/or IL-17A/F including combinations thereof with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter.

Aspect F-11: An amino acid sequence according to any of aspects F-1 to F-10, that can specifically bind to any of IL-17A, IL-17F and/or IL-17A/F including combinations thereof with a rate of association ($k_{on}$-rate) of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$.

Aspect F-12: An amino acid sequence according to any of aspects F-1 to F-11, that can specifically bind to any of IL-17A, IL-17F and/or IL-17A/F including combinations thereof with a rate of dissociation ($k_{off}$-rate) between 1 $s^{-1}$ and $10^{-6}$ $s^{-1}$ preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Aspect F-13: An amino acid sequence according to any of aspects F-1 to F-12, that can specifically bind to any of IL-17A, IL-17F and/or IL-17A/F including combinations thereof with an affinity less than 500 nM, preferably less than 200 nM, more preferably less than 10 nM, such as less than 500 pM.

Aspect F-14: An amino acid sequence according to any of aspects F-1 to F-13, that is a naturally occurring amino acid sequence (from any suitable species) or a synthetic or semi-synthetic amino acid sequence.

Aspect F-15: An amino acid sequence according to any of aspects F-1 to F-14, that comprises an immunoglobulin fold or that under suitable conditions is capable of forming an immunoglobulin fold.

Aspect F-16: An amino acid sequence according to any of aspects F-1 to F-15, that is an immunoglobulin sequence, and in particular an ISV.

Aspect F-17: An amino acid sequence according to any of aspects F-1 to F-16, that is a naturally occurring immunoglobulin sequence (from any suitable species) or a synthetic or semi-synthetic immunoglobulin sequence.

Aspect F-18: An amino acid sequence according to any of aspects F-1 to F-17, that is a humanized immunoglobulin sequence, a camelized immunoglobulin sequence or an immunoglobulin sequence that has been obtained by techniques such as affinity maturation.

Aspect F-19: An amino acid sequence according to any of aspects F-1 to F-18, that essentially consists of a light chain variable domain sequence (e.g. a $V_L$-sequence); or of a heavy chain variable domain sequence (e.g. a $V_H$-sequence)

Aspect F-20: An amino acid sequence according to any of aspects F-1 to F-19, that essentially consists of a heavy chain variable domain sequence that is derived from a conventional four-chain antibody or that essentially consist of a heavy chain variable domain sequence that is derived from heavy chain antibody.

Aspect F-21: An amino acid sequence according to any of aspects F-1 to F-20, that essentially consists of a domain antibody (or an amino acid sequence that is suitable for use as a domain antibody), of a single domain antibody (or an amino acid sequence that is suitable for use as a single domain antibody), of a "dAb" (or an amino acid sequence that is suitable for use as a dAb) or of a Nanobody (including but not limited to a $V_{HH}$ sequence).

Aspect F-22: An amino acid sequence according to any of aspects F-1 to F-21, that essentially consists of a Nanobody.

Aspect F-23: An amino acid sequence according to any of aspects F-1 to F-22, that essentially consists of a Nanobody that i) has at least 80% amino acid identity with at least one of the amino acid sequences of SEQ ID NOs: 1 to 22, in which for the purposes of determining the degree of amino acid identity, the amino acid residues that form the CDR sequences are disregarded;

and in which:

ii) preferably one or more of the amino acid residues at positions 11, 37, 44, 45, 47, 83, 84, 103, 104 and 108 according to the Kabat numbering are chosen from the Hallmark residues mentioned in Table B-2.

Aspect F-24: An amino acid sequence according to any of aspects F-1 to F-23, that essentially consists of a Nanobody that i) has at least 80% amino acid identity with at least one of the amino acid sequences of SEQ ID NOs: 623 to 693, in which for the purposes of determining the degree of amino acid identity, the amino acid residues that form the CDR sequences are disregarded;

and in which:

ii) preferably one or more of the amino acid residues at positions 11, 37, 44, 45, 47, 83, 84, 103, 104 and 108 according to the Kabat numbering are chosen from the Hallmark residues mentioned in Table B-2.

Aspect F-25: An amino acid sequence according to any of aspects F-1 to F-24, that essentially consists of a humanized Nanobody.

Aspect G-1: An amino acid sequence according to any of the preceding aspects, that in addition to the at least one binding site for binding formed by the CDR sequences, contains one or more further binding sites (e.g. as binding units) for binding against another antigen, protein or target.

Aspect H-1: Nanobody that is directed against and/or that can specifically bind (e.g. as a binding unit) to any of IL-17A, IL-17F and/or IL-17A/F including combinations thereof.

Aspect H-2: Nanobody according to aspect H-1, that is in essentially isolated form.

Aspect H-3: Nanobody according to any of aspects H-1 to H-2, that can specifically bind to any of IL-17A, IL-17F and/or IL-17A/F including combinations thereof with a dissociation constant ($K_D$) of $10^{-5}$ to $10^{12}$ moles/liter or less, and preferably $10^{-7}$ to $10^{12}$ moles/liter or less and more preferably $10^{-8}$ to $10^{-12}$ moles/liter.

Aspect H-4: Nanobody according to any of aspects H-1 to H-3, that can specifically bind to any of IL-17A, IL-17F and/or IL-17A/F including combinations thereof with a rate of association ($k_w$-rate) of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$.

Aspect H-5: Nanobody according to any of aspects H-1 to H-4, that can specifically bind to any of IL-17A, IL-17F and/or IL-17A/F including combinations thereof with a rate of dissociation ($k_{off}$ rate) between 1 $s^{-1}$ and $10^{-6}$ $s^{-1}$ preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Aspect H-6: Nanobody according to any of aspects H-1 to H-5, that can specifically bind to any of IL-17A, IL-17F and/or IL-17A/F including combinations thereof with an affinity less than 500 nM, preferably less than 200 nM, more preferably less than 10 nM, such as less than 500 pM.

Aspect H-7: Nanobody according to any of aspects H-1 to H-6, that is a naturally occurring Nanobody (from any suitable species) or a synthetic or semi-synthetic Nanobody.

Aspect H-8: Nanobody according to any of aspects to H-1 to H-7, that is a $V_{HH}$ sequence, a partially humanized $V_{HH}$ sequence, a fully humanized $V_{HH}$ sequence, a camelized heavy chain variable domain or a Nanobody that has been obtained by techniques such as affinity maturation.

Aspect H-9: Nanobody according to any of aspects H-1 to H-8, that i) has at least 80% amino acid identity with at least one of the An amino acid sequences of SEQ ID NOs: 1 to 22, in which for the purposes of determining the degree of amino acid identity, the amino acid residues that form the CDR sequences are disregarded;

and in which:

ii) preferably one or more of the amino acid residues at positions 11, 37, 44, 45, 47, 83, 84, 103, 104 and 108 according to the Kabat numbering are chosen from the Hallmark residues mentioned in Table B-2.

Aspect H-10: Nanobody according to any of aspects H-1 to H-9, that i) has at least 80% amino acid identity with at least one of the An amino acid sequences of SEQ ID NOs: 623 to 693, in which for the purposes of determining the degree of amino acid identity, the amino acid residues that form the CDR sequences are disregarded;

and in which:

ii) preferably one or more of the amino acid residues at positions 11, 37, 44, 45, 47, 83, 84, 103, 104 and 108 according to the Kabat numbering are chosen from the Hallmark residues mentioned in Table B-2.

Aspect H-11: Nanobody according to any of aspects H-1 to H-10, in which:

CDR1 is chosen from the group consisting of:

a) the amino acid sequences of SEQ ID NOs: 197 to 267;
b) amino acid sequences that have at least 80% amino acid identity with at least one of the amino acid sequences of SEQ ID NOs: 197 to 267;
c) amino acid sequences that have 3, 2, or 1 amino acid difference with at least one of the amino acid sequences of SEQ ID NOs: 197 to 267;

and/or

CDR2 is chosen from the group consisting of:

d) the amino acid sequences of SEQ ID NOs: 339 to 409;
e) amino acid sequences that have at least 80% amino acid identity with at least one of the amino acid sequences of SEQ ID NOs: 339 to 409;
f) amino acid sequences that have 3, 2, or 1 amino acid difference with at least one of the amino acid sequences of SEQ ID NOs: 339 to 409;

and/or

CDR3 is chosen from the group consisting of:

g) the amino acid sequences of SEQ ID NOs: 481 to 551;
h) amino acid sequences that have at least 80% amino acid identity with at least one of the amino acid sequences of SEQ ID NOs: 481 to 551;
i) amino acid sequences that have 3, 2, or 1 amino acid difference with at least one of the amino acid sequences of SEQ ID NOs: 481 to 551.

Aspect H-12: Nanobody according to any of aspects H-1 to H-11, in which:

CDR1 is chosen from the group consisting of:

a) the amino acid sequences of SEQ ID NOs: 197 to 267;
b) amino acid sequences that have at least 80% amino acid identity with at least one of the amino acid sequences of SEQ ID NOs: 197 to 267;
c) amino acid sequences that have 3, 2, or 1 amino acid difference with at least one of the amino acid sequences of SEQ ID NOs: 197 to 267;

and

CDR2 is chosen from the group consisting of:

d) the amino acid sequences of SEQ ID NOs: 339 to 409;
e) amino acid sequences that have at least 80% amino acid identity with at least one of the amino acid sequences of SEQ ID NOs: 339 to 409;
f) amino acid sequences that have 3, 2, or 1 amino acid difference with at least one of the amino acid sequences of SEQ ID NOs: 339 to 409; and CDR3 is chosen from the group consisting of:

g) the amino acid sequences of SEQ ID NOs: 481 to 551;
h) amino acid sequences that have at least 80% amino acid identity with at least one of the amino acid sequences of SEQ ID NOs: 481 to 551;
i) amino acid sequences that have 3, 2, or 1 amino acid difference with at least one of the amino acid sequences of SEQ ID NOs: 481 to 551.

Aspect H-13: Nanobody according to any of aspects H-1 to H-12, in which the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NOs: 623 to 693.

Aspect H-14: Nanobody according to any of aspects H-1 to H-13, which is a partially humanized Nanobody.

Aspect H-15: Nanobody according to any of aspects H-1 to H-14, which is a fully humanized Nanobody.

Aspect H-16: Nanobody according to any of aspects H-1 to H-15, that is chosen from the group consisting of SEQ ID NOs: 623 to 693 or from the group consisting of from amino acid sequences that have more than 80%, preferably more than 90%, more preferably more than 95%, such as 99% or more sequence identity (as defined herein) with at least one of the amino acid sequences of SEQ ID NOs: 623 to 693.

Aspect H-17: Nanobody according to any of aspects H-1 to H-16, which is a humanized Nanobody that is chosen from the group consisting of from amino acid sequences that have more than 80%, preferably more than 90%, more preferably more than 95%, such as 99% or more sequence identity (as defined herein) with at least one of the amino acid sequences of SEQ ID NOs: 623 to 693.

Aspect H-18: Nanobody according to any of aspects H-1 to H-17, that is chosen from the group consisting of SEQ ID NOs: 623 to 693.

Aspect H-19: Nanobody directed against any of IL-17A, IL-17F and/or IL-17A/F including combinations thereof that cross-blocks the binding of at least one of the amino acid sequences of SEQ ID NOs: 623 to 693 to any of IL-17A, IL-17F and/or IL-17A/F including combinations thereof.

Aspect H-20: Nanobody directed against any of IL-17A, IL-17F and/or IL-17A/F including combinations thereof that is cross-blocked from binding to any of IL-17A, IL-17F and/or IL-17A/F including combinations thereof by at least one of the amino acid sequences of SEQ ID NOs: 623 to 693.

Aspect H-21: Nanobody according to any of aspects H-19 or H-20 wherein the ability of said Nanobody to cross-block or to be cross-blocked is detected in a Biacore assay.

Aspect H-22: Nanobody according to any of aspects H-19 to H-21 wherein the ability of said Nanobody to cross-block or to be cross-blocked is detected in an ELISA assay Polypeptides.

Aspect K-1: Polypeptide that comprises or essentially consists of one or more amino acid sequences according to any of aspects A-1 to A-54, B-1 to B-8, C-1 to C-5, D-1 to D-7, E-1 to E-14, F-1 to F-25 or G-1 and/or one or more Nanobodies according to any of aspects H-1 to H-22, and optionally further comprises one or more peptidic linkers and/or one or more other groups, residues, moieties or binding units.

Aspect K-2: Polypeptide according to aspect K-1, in which said one or more binding units are immunoglobulin sequences, and in particular ISV's.

Aspect K-3: Polypeptide according to any of aspects K-1 or K-2, in which said one or more other groups, residues, moieties or binding units are chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or Nanobodies.

Aspect K-4: Polypeptide according to any of aspects K-1 to K-3, in which said one or more amino acid sequences of the invention are immunoglobulin sequences.

Aspect K-5: Polypeptide according to any of aspects K-1 to K-4, in which said one or more amino acid sequences of the invention are chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or Nanobodies.

Aspect K-6: Polypeptide according to any of aspects K-1 to K-5, that comprises or essentially consists of one or more Nanobodies according to any of aspects H-1 to H-22 and in which said one or more other binding units are Nanobodies.

Aspect K-7: Polypeptide according to any of aspects K-1 to K-6, wherein at least one binding unit is a multivalent construct.

Aspect K-8: Polypeptide according to any of aspects K-1 to K-8, wherein at least one binding unit is a multiparatopic construct.

Aspect K-9: Polypeptide according to any of aspects K-1 to K-8, wherein at least one binding unit is a multispecific construct.

Aspect K-10: Polypeptide according to any of aspects K-1 to K-9, which has an increased half-life, compared to the corresponding amino acid sequence according to any of aspects A-1 to A-54, B-1 to B-8, C-1 to C-5, D-1 to D-7, E-1 to E-14, F-1 to F-25 or G-1 per se or Nanobody according to any of aspects H-1 to H-22 per se, respectively.

Aspect K-11: Polypeptide according to aspect K-10, in which said one or more other binding units provide the polypeptide with increased half-life, compared to the corresponding amino acid sequence according to any of aspects A-1 to A-54, B-1 to B-8, C-1 to C-5, D-1 to D-7, E-1 to E-14, F-1 to F-25 or G-1 per se or Nanobody according to any of aspects H-1 to H-22 per se, respectively.

Aspect K-12: Polypeptide according to aspect K-10 or K-11, in which said one or more other binding units that provide the polypeptide with increased half-life is chosen from the group consisting of serum proteins or fragments thereof, binding units that can bind to serum proteins, an Fc portion, and small proteins or peptides that can bind to serum proteins.

Aspect K-13: Polypeptide according to any of aspects K-10 to K-12, in which said one or more other binding units that provide the polypeptide with increased half-life is chosen from the group consisting of human serum albumin or fragments thereof.

Aspect K-14: Polypeptide according to any of aspect K-10 to K-13, in which said one or more other binding units that provides the polypeptide with increased half-life are chosen from the group consisting of binding units that can bind to serum albumin (such as human serum albumin) or a serum immunoglobulin (such as IgG).

Aspect K-15: Polypeptide according to any of aspects K-10 to K-14, in which said one or more other binding units that provides the polypeptide with increased half-life are chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or Nanobodies that can bind to serum albumin (such as human serum albumin) or a serum immunoglobulin (such as IgG).

Aspect K-16: Polypeptide according to aspect K-10 to K-15, in which said one or more other binding units that provides the polypeptide with increased half-life is a Nanobody that can bind to serum albumin (such as human serum albumin) or a serum immunoglobulin (such as IgG).

Aspect K-17: Polypeptide according to any of aspects K-10 to K-16, that has a serum half-life that is at least 1.5 times, preferably at least 2 times, such as at least 5 times, for example at least 10 times or more than 20 times, greater than the half-life of the corresponding amino acid sequence according to any of aspects A-1 to A-54, B-1 to B-8, C-1 to C-5, D-1 to D-7, E-1 to E-14, F-1 to F-25 or G-1 per se or Nanobody according to any of aspects H-1 to H-22 per se, respectively.

Aspect K-18: Polypeptide according to any of aspects K-10 to K-17, that has a serum half-life that is increased with more than 1 hours, preferably more than 2 hours, more preferably more than 6 hours, such as more than 12 hours, or even more than 24, 48 or 72 hours, compared to the corresponding amino acid sequence according to any of aspects A-1 to A-54, B-1 to B-8, C-1 to C-5, D-1 to D-7, E-1 to E-14, F-1 to F-25 or G-1 per se or Nanobody according to any of aspects H-1 to H-22 per se, respectively.

Aspect K-19: Polypeptide according to any of aspects K-1 to K-18, that has a serum half-life in human of at least about 12 hours, preferably at least 24 hours, more preferably at least 48 hours, even more preferably at least 72 hours or more; for example, of at least 5 days (such as about 5 to 10 days), preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days).

Compound or Construct.

Aspect L-1: Compound or construct, that comprises or essentially consists of one or more amino acid sequences according to any of aspects A-1 to A-54, B-1 to B-8, C-1 to C-5, D-1 to D-7, E-1 to E-14, F-1 to F-25 or G-1 and/or one or more Nanobodies according to any of aspects H-1 to H-22, and optionally further comprises one or more other groups, residues, moieties or binding units, optionally linked via one or more linkers.

Aspect L-2: Compound or construct according to aspects L-1, in which said one or more other groups, residues, moieties or binding units are amino acid sequences.

Aspect L-3: Compound or construct according to aspect L-1 or L-2, in which said one or more linkers, if present, are one or more amino acid sequences.

Aspect L-4: Compound or construct according to any of aspects L-1 to L-3, in which said one or more other groups, residues, moieties or binding units are immunoglobulin sequences, and in particular ISV's.

Aspect L-5: Compound or construct according to any of aspects L-1 to L-4, in which said one or more other groups, residues, moieties or binding units are chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or Nanobodies.

Aspect L-6: Compound or construct according to any of aspects L-1 to L-5, in which said one or more amino acid sequences of the invention are immunoglobulin sequences.

Aspect L-7: Compound or construct according to any of aspects L-1 to L-6, in which said one or more amino acid sequences of the invention are chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or Nanobodies.

Aspect L-8: Compound or construct, that comprises or essentially consists of one or more Nanobodies according to any of aspects H-1 to H-22 and in which said one or more other groups, residues, moieties or binding units are Nanobodies.

Aspect L-9: Compound or construct according to any of aspects L-1 to L-9, which is a multivalent construct.

Aspect L-10: Compound or construct according to any of aspects L-1 to L-10, which is a multispecific construct.

Aspect L-11: Compound or construct according to any of aspects L-1 to L-10, which has an increased half-life, compared to the corresponding amino acid sequence according to any of aspects A-1 to A-54, B-1 to B-8, C-1 to C-5, D-1 to D-7, E-1 to E-14, F-1 to F-25 or G-1 per se or Nanobody according to any of aspects H-1 to H-22 per se, respectively.

Aspect L-12: Compound or construct according to aspect L-1 to L-11, in which said one or more other groups, residues, moieties or binding units provide the compound or construct with increased half-life, compared to the corresponding amino acid sequence according to any of aspects A-1 to A-54, B-1 to B-8, C-1 to C-5, D-1 to D-7, E-1 to E-14, F-1 to F-25 or G-1 per se or Nanobody according to any of aspects H-1 to H-22 per se, respectively.

Aspect L-13: Compound or construct according to aspect L-12, in which said one or more other groups, residues, moieties or binding units that provide the compound or construct with increased half-life is chosen from the group consisting of serum proteins or fragments thereof, binding units that can bind to serum proteins, an Fc portion, and small proteins or peptides that can bind to serum proteins.

Aspect L-14: Compound or construct according to aspect L-12 or L-13, in which said one or more other groups, residues, moieties or binding units that provide the compound or construct with increased half-life is chosen from the group consisting of human serum albumin or fragments thereof.

Aspect L-15: Compound or construct according to any of aspects L-12 to L-14, in which said one or more other groups, residues, moieties or binding units that provides the compound or construct with increased half-life are chosen from the group consisting of binding units that can bind to serum albumin (such as human serum albumin) or a serum immunoglobulin (such as IgG).

Aspect L-16: Compound or construct according to any of aspects L-12 to L-14, in which said one or more other groups, residues, moieties or binding units that provides the compound or construct with increased half-life are chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or Nanobodies that can bind to serum albumin (such as human serum albumin) or a serum immunoglobulin (such as IgG).

Aspect L 17: Compound or construct according to any of aspects L-12 to L-14, in which said one or more other groups, residues, moieties or binding units that provides the compound or construct with increased half-life is a Nanobody that can bind to serum albumin (such as human serum albumin) or a serum immunoglobulin (such as IgG).

Aspect L-18: Compound or construct according to any of aspects L-12 to L-17, that has a serum half-life that is at least 1.5 times, preferably at least 2 times, such as at least 5 times, for example at least 10 times or more than 20 times, greater than the half-life of the corresponding amino acid sequence according to any of aspects A-1 to A-54, B-1 to B-8, C-1 to C-5, D-1 to D-7, E-1 to E-14, F-1 to F-25 or G-1 per se or Nanobody according to any of aspects H-1 to H-22 per se, respectively.

Aspect L-19: Compound or construct according to any of aspects L-12 to L-18, that has a serum half-life that is increased with more than 1 hours, preferably more than 2 hours, more preferably more than 6 hours, such as more than 12 hours, or even more than 24, 48 or 72 hours, compared to the corresponding amino acid sequence according to any of aspects A-1 to A-54, B-1 to B-8, C-1 to C-5, D-1 to D-7, E-1 to E-14, F-1 to F-25 or G-1 per se or Nanobody according to any of aspects H-1 to H-22 per se, respectively.

Aspect L-20: Compound or construct according to any of aspects L-12 to L-19, that has a serum half-life in human of at least about 12 hours, preferably at least 24 hours, more preferably at least 48 hours, even more preferably at least 72 hours or more; for example, of at least 5 days (such as about 5 to 10 days), preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days).

Aspect L-21: Monovalent construct, comprising or essentially consisting of one amino acid sequence according to any of aspects A-1 to A-54, B-1 to B-8, C-1 to C-5, D-1 to D-7, E-1 to E-14, F-1 to F-25 or G-1 and/or one Nanobody according to any of aspects H-1 to H-22.

Aspect L-22: Monovalent construct according to aspect L-21, in which said amino acid sequence of the invention is chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or Nanobodies.

Aspect L-23: Monovalent construct, comprising or essentially consisting of one Nanobody according to any of aspects H-1 to H-22.

Nucleic Acid

Aspect M-1: Nucleic acid or nucleotide sequence, that encodes an amino acid sequence according to any of aspects A-1 to A-54, B-1 to B-8, C-1 to C-5, D-1 to D-7, E-1 to E-14, F-1 to F-25 or G-1, a Nanobody according to any of aspects H-1 to H-22, a compound or construct according to any of aspects that is such that it can be obtained by expression of a nucleic acid or nucleotide sequence encoding the same, or a monovalent construct according to any of aspects.

Aspect M-2: Nucleic acid or nucleotide sequence according to aspect M-1, that is in the form of a genetic construct.

Host Cell

Aspect N-1: Host or host cell that expresses, or that under suitable circumstances is capable of expressing, an amino acid sequence according to any of aspects A-1 to A-54, B-1 to B-8, C-1 to C-5, D-1 to D-7, E-1 to E-14, F-1 to F-25 or G-1, a Nanobody according to any of aspects H-1 to H-22, a polypeptide according to any of aspects K-1 to K-19, a compound or construct according to any of aspects L-1 to L-21 that is such that it can be obtained by expression of a nucleic acid or nucleotide sequence encoding the same, or a monovalent construct according to any of aspects L-22 or L-23; and/or that comprises a nucleic acid or nucleotide sequence according to aspect M-1 or a genetic construct according to aspect M-2.

Compositions

Aspect O-1: Composition comprising at least one amino acid sequence according to any of aspects A-1 to A-5454, B-1 to B-8, C-1 to C-5, D-1 to D-7, E-1 to E-14, F-1 to F-25 or G-1, Nanobody according to any of aspects H-1 to H-22, polypeptide according to any of aspects K-1 to K-19, compound or construct according to any of aspects L-1 to L-21, monovalent construct according to any of aspects L-22 or L-23, or nucleic acid or nucleotide sequence according to aspects M-1 or M-2.

Aspect O-2: Composition according to aspect O-1, which is a pharmaceutical composition.

Aspect O-3: Composition according to aspect O-2, which is a pharmaceutical composition, that further comprises at least one pharmaceutically acceptable carrier, diluent or excipient and/or adjuvant, and that optionally comprises one or more further pharmaceutically active polypeptides and/or compounds.

Making of Agent and Composition of the Invention

Aspect P-1: Method for producing an amino acid sequence according to any of aspects A-1 to A-54, B-1 to B-8, C-1 to C-5, D-1 to D-7, E-1 to E-14, F-1 to F-25 or G-1, a Nanobody according to any of aspects H-1 to H-22, a polypeptide according to any of aspects K-1 to K-19, a compound or construct according to any of aspects L-1 to L-21 that is such that it can be obtained by expression of a nucleic acid or nucleotide sequence encoding the same, or a monovalent construct according to any of aspects L-22 or L-23, said method at least comprising the steps of:

a) expressing, in a suitable host cell or host organism or in another suitable expression system, a nucleic acid or nucleotide sequence according to aspect M-1, or a genetic construct according to aspect M-2;

optionally followed by:

b) isolating and/or purifying the amino acid sequence according to any of aspects A-1 to A-54, B-1 to B-8, C-1 to C-5, D-1 to D-7, E-1 to E-14, F-1 to F-25 or G-1, a Nanobody according to any of aspects H-1 to H-22, a polypeptide according to any of aspects K-1 to K-19, a compound or construct according to any of aspects L-1 to L-21, or a monovalent construct according to any of aspects L-22 or L-23 thus obtained.

Aspect P-2: Method for producing an amino acid sequence according to any of aspects A-1 to A-54, B-1 to B-8, C-1 to C-5, D-1 to D-7, E-1 to E-14, F-1 to F-25 or G-1, a Nanobody according to any of aspects H-1 to H-22, a polypeptide according to any of aspects K-1 to K-19, a compound or construct according to any of aspects L-1 to L-21 that is such that it can be obtained by expression of a nucleic acid or nucleotide sequence encoding the same, or a monovalent construct according to any of aspects L-22 or L-23, said method at least comprising the steps of:

a) cultivating and/or maintaining a host or host cell according to aspect . . . under conditions that are such that said host or host cell expresses and/or produces at least one amino acid sequence according to any of aspects A-1 to A-54, B-1 to B-8, C-1 to C-5, D-1 to D-7, E-1 to E-14, F-1 to F-25 or G-1, Nanobody according to any of aspects H-1 to H-22, a polypeptide according to any of aspects K-1 to K-19, a compound or construct according to any of aspects L-1 to L-21, or monovalent construct according to any of aspects L-22 or L-23;

optionally followed by:

b) isolating and/or purifying the amino acid sequence according to any of aspects A-1 to A-54, B-1 to B-8, C-1 to C-5, D-1 to D-7, E-1 to E-14, F-1 to F-25 or G-1, Nanobody according to any of aspects H-1 to H-22, a polypeptide according to any of aspects K-1 to K-19, a compound or construct according to any of aspects L-1 to L-21, or monovalent construct according to any of aspects L-22 or L-23 thus obtained.

Method of Screening Using Leads

Aspect Q-1: Method for screening amino acid sequences directed against any of IL-17A, IL-17F and/or IL-17A/F including combinations thereof that comprises at least the steps of:

a) providing a set, collection or library of nucleic acid sequences encoding amino acid sequences;

b) screening said set, collection or library of nucleic acid sequences for nucleic acid sequences that encode an amino acid sequence that can bind to and/or has affinity for any of IL-17A, IL-17F and/or IL-17A/F including combinations thereof and that is cross-blocked or is cross blocking a Nanobody of the invention, e.g. SEQ ID NO: 623 to 693 (Table-1); and c) isolating said nucleic acid sequence, followed by expressing said amino acid sequence.

Use of Binding Agent of the Invention

Aspect R-1: Method for the prevention and/or treatment of at least one immune related diseases and disorders of the invention, said method comprising administering, to a subject in need thereof, a pharmaceutically active amount of at least one amino acid sequence according to any of aspects A-1 to A-54, B-1 to B-8, C-1 to C-5, D-1 to D-7, E-1 to E-14, F-1 to F-25 or G-1, Nanobody according to any of aspects H-1 to H-22, polypeptide according to any of aspects K-1 to K-19, compound or construct according to any of aspects L-1 to L-21, monovalent construct according to any of aspects L-22 or L-23; or composition according to aspect O-2 or O-3.

Aspect R-2: Method for the prevention and/or treatment of at least one disease or disorder that is associated with any of IL-17A, IL-17F and/or IL-17A/F including combinations thereof, with its biological or pharmacological activity, and/or with the biological pathways or signalling in which any of IL-17A, IL-17F and/or IL-17A/F including combinations thereof is involved, said method comprising administering, to a subject in need thereof, a pharmaceutically active amount of at least one amino acid sequence according to any of aspects A-1 to A-54, B-1 to B-8, C-1 to C-5, D-1 to D-7, E-1 to E-14, F-1 to F-25 or G-1, Nanobody according to any of aspects H-1 to H-22, polypeptide according to any of aspects K-1 to K-19, compound or construct according to any of aspects L-1 to L-21, monovalent construct according to any of aspects L-22 or L-23; or composition according to aspect O-2 or O-3.

Aspect R-3: Method for the prevention and/or treatment of at least one disease or disorder that can be prevented and/or treated by administering, to a subject in need thereof, at least one amino acid sequence according to any of aspects A-1 to A-54, B-1 to B-8, C-1 to C-5, D-1 to D-7, E-1 to E-14, F-1 to F-25 or G-1, Nanobody according to any of aspects H-1 to H-22, polypeptide according to any of aspects K-1 to K-19, compound or construct according to any of aspects L-1 to L-21, monovalent construct according to any of aspects L-22 or L-23; or composition according to aspect O-2 or O-3, said method comprising administering, to a subject in need thereof, a pharmaceutically active amount of at least one at least one amino acid sequence according to any of aspects A-1 to A-54, B-1 to B-8, C-1 to C-5, D-1 to D-7, E-1 to E-14, F-1 to F-25 or G-1, Nanobody according to any of aspects H-1 to H-22, polypeptide according to any of aspects K-1 to K-19, compound or construct according to any of aspects L-1 to L-21, monovalent construct according to any of aspects L-22 or L-23; or composition according to aspect O-2 or O-3.

Aspect R-4: Method for immunotherapy, said method comprising administering, to a subject in need thereof, a pharmaceutically active amount of at least one amino acid sequence according to any of aspects A-1 to A-54, B-1 to B-8, C-1 to C-5, D-1 to D-7, E-1 to E-14, F-1 to F-25 or G-1, Nanobody according to any of aspects H-1 to H-22, polypeptide according to any of aspects K-1 to K-19, compound or construct according to any of aspects L-1 to L-21, monovalent construct according to any of aspects L-22 or L-23; or composition according to aspect O-2 or O-3.

Aspect R-5: Use of an amino acid sequence according to any of aspects A-1 to A-54, B-1 to B-8, C-1 to C-5, D-1 to D-7, E-1 to E-14, F-1 to F-25 or G-1, a Nanobody according to any of aspects H-1 to H-22, a polypeptide according to any of aspects K-1 to K-19, a compound or construct according to any of aspects L-1 to L-21, or a monovalent construct according to any of aspects L-22 or L-23 in the preparation of a pharmaceutical composition for prevention and/or treatment of at least one immune related diseases and disorders of the invention; and/or for use in one or more of the methods according to aspects R-1 to R-3.

Aspect R-6: Amino acid sequence according to any of aspects A-1 to A-54, B-1 to B-8, C-1 to C-5, D-1 to D-7, E-1 to E-14, F-1 to F-25 or G-1, Nanobody according to any of aspects H-1 to H-22, polypeptide according to any of aspects K-1 to K-19, compound or construct according to any of aspects L-1 to L-21, monovalent construct according to any of aspects L-22 or L-23; or composition according to aspect O-2 or O-3 for the prevention and/or treatment of at least one immune related diseases and disorders of the invention.

Fragment Aspects

Aspect S-1: Part or fragment of an amino acid sequence according to any of aspects A-1 to A-54, B-1 to B-8, C-1 to C-5, D-1 to D-7, E-1 to E-14, F-1 to F-25 or G-1, or of a Nanobody according to any of aspects H-1 to H-22.

Aspect S-2: Part or fragment according to aspect S-1, that can specifically bind to any of IL-17A, IL-17F and/or IL-17A/F including combinations thereof.

Aspect S-3: Part of fragment according to any of aspects S-1 or S-2, that can specifically bind to any of IL-17A, IL-17F and/or IL-17A/F including combinations thereof with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter.

Aspect S-4: Part or fragment according to any of aspects S-1 to S-3, that can specifically bind to any of IL-17A, IL-17F and/or IL-17A/F including combinations thereof with a rate of association ($k_{on}$-rate) of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$.

Aspect S-5: Part or fragment according to any of aspects S-1 to S-4, that can specifically bind to any of IL-17A, IL-17F and/or IL-17A/F including combinations thereof with a rate of dissociation ($k_{off}$ rate) between 1 $s^{-1}$ and $10^{-6}$ $s^{-1}$ preferably between $10^{-2}s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Aspect S-6: Compound or construct, that comprises or essentially consists of one or more parts or fragments according to any of aspects S-1 to S-4, and optionally further comprises one or more other groups, residues, moieties or binding units, optionally linked via one or more linkers.

Aspect S-7: Compound or construct according to aspect S-6, in which said one or more other groups, residues, moieties or binding units are amino acid sequences.

Aspect S-8: Compound or construct according to aspect S-6 or S-7, in which said one or more linkers, if present, are one or more amino acid sequences.

Aspect S-9: Nucleic acid or nucleotide sequence, that encodes a part or fragment according to any of aspects S-1 to S-7 or a compound or construct according to aspect S-8.

Aspect S-10: Composition, comprising at least one part or fragment according to any of aspects S-1 to S-7, compound or construct according to any of aspects S-6 to S-8, or nucleic acid or nucleotide sequence according to aspect S-9.

Derivatives Aspects

Aspect T-1: Derivative of an amino acid sequence according to any of aspects A-1 to A-54, B-1 to B-8, C-1 to C-5, D-1 to D-7, E-1 to E-14, F-1 to F-25 or G-1, or of a Nanobody according to any of aspects H-1 to H-22.

Aspect T-2: Derivative according to aspect T-1, that can specifically bind to any of IL-17A, IL-17F and/or IL-17A/F including combinations thereof.

Aspect T-3: Derivative according to any of aspects T-1 or T-2, that can specifically bind to any of IL-17A, IL-17F and/or IL-17 A/F including combinations thereof with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter.

Aspect T-4: Derivative according to any of aspects T-1 to T-3, that can specifically bind to any of IL-17A, IL-17F and/or IL-17A/F including combinations thereof with a rate of association ($k_{on}$-rate) of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$.

Aspect T-5: Derivative according to any of aspects T-1 to T-4, that can specifically bind to any of IL-17A, IL-17F and/or IL-17A/F including combinations thereof with a rate of dissociation ($k_{on}$-rate) between 1 $s^{-1}$ and $10^{-6}$ $s^{-1}$ preferably between $10^{-2}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Aspect T-6: Derivative of a polypeptide according to any of aspects K-1 to K-19 or compound or construct according to any of aspects L-1 to L-23.

Aspect T-7: Derivative according to aspect T-6, that can specifically bind to any of IL-17A, IL-17F and/or IL-17A/F including combinations thereof.

Aspect T-8: Derivative according to any of aspects T-6 or T-7, that can specifically bind to any of IL-17A, IL-17F and/or IL-17A/F including combinations thereof with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter.

Aspect T-9: Derivative according to any of aspects T-6 to T-8, that can specifically bind to any of IL-17A, IL-17F and/or IL-17A/F including combinations thereof with a rate of association ($k_{on}$-rate) of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$.

Aspect T-10: Derivative according to any of aspects T-6 to T-9, that can specifically bind to any of IL-17A, IL-17F and/or IL-17A/F including combinations thereof with a rate of dissociation ($k_{off}$ rate) between 1 $s^{-1}$ and $10^{-6}$ $s^{-1}$ preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Aspect T-11: Derivative according to any of aspects T-1 to T-10, that has a serum half-life that is at least 1.5 times, preferably at least 2 times, such as at least 5 times, for example at least 10 times or more than 20 times, greater than the half-life of the corresponding amino acid sequence according to any of aspects A-1 to A-54, B-1 to B-8, C-1 to C-5, D-1 to D-7, E-1 to E-14, F-1 to F-25 or G-1 per se, Nanobody according to any of aspects H-1 to H-22 per se, polypeptide according to any of aspects K-1 to K-19 or compound or construct according to any of aspects L-1 to L-23 per se.

Aspect T-12: Derivative according to any of aspects T-1 to T-11, that has a serum half-life that is increased with more than 1 hours, preferably more than 2 hours, more preferably more than 6 hours, such as more than 12 hours, or even more than 24, 48 or 72 hours, compared to the corresponding amino acid sequence according to any of aspects A-1 to A-54, B-1 to B-8, C-1 to C-5, D-1 to D-7, E-1 to E-14, F-1 to F-25 or G-1 per se, Nanobody according to any of aspects H-1 to H-23 per se, polypeptide according to any of aspects K-1 to K-19 or compound or construct according to any of aspects L-1 to L-23 per se, respectively.

Aspect T-13: Derivative according to any of aspects T-1 to T-12, that has a serum half-life in human of at least about 12 hours, preferably at least 24 hours, more preferably at least 48 hours, even more preferably at least 72 hours or more; for example, at least 5 days (such as about 5 to 10 days), preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days).

Aspect T-14: Derivative according to any of aspects T-1 to T-13, that is a pegylated derivative.

Aspect T-15: Compound or construct, that comprises or essentially consists of one or more derivatives according to any of aspects T-1 to T-14, and optionally further comprises one or more other groups, residues, moieties or binding units, optionally linked via one or more linkers.

Aspect T-16: Compound or construct according to aspect T-15, in which said one or more other groups, residues, moieties or binding units are amino acid sequences.

Aspect T-17: Compound or construct according to aspect T-16, in which said one or more linkers, if present, are one or more amino acid sequences.

Aspect T-18: Nucleic acid encoding a compound or construct according to aspect T-16 or T-17.

Aspect T-19: Composition, comprising at least one derivative to any of aspects T-1 to T-14, compound or construct according to any of aspects T-15 to T-17, or nucleic acid or nucleotide sequence according to aspect T-18.

The invention will now be further illustrated by means of the following non-limiting Examples and non-limiting Figures. The sequences of the amino acid sequences of the invention and of the polypeptides of the invention that are referred to in the Examples are given in the sequence listing as well as in FIGS. 5 to 8.

LEGEND TO FIGURES

FIG. 1: Exemplary graph of the IC50 determination of Class 2 Nanobodies in AlphaScreen for blocking of the hIL-17A-hIL-17RA interaction.

Figure 2:
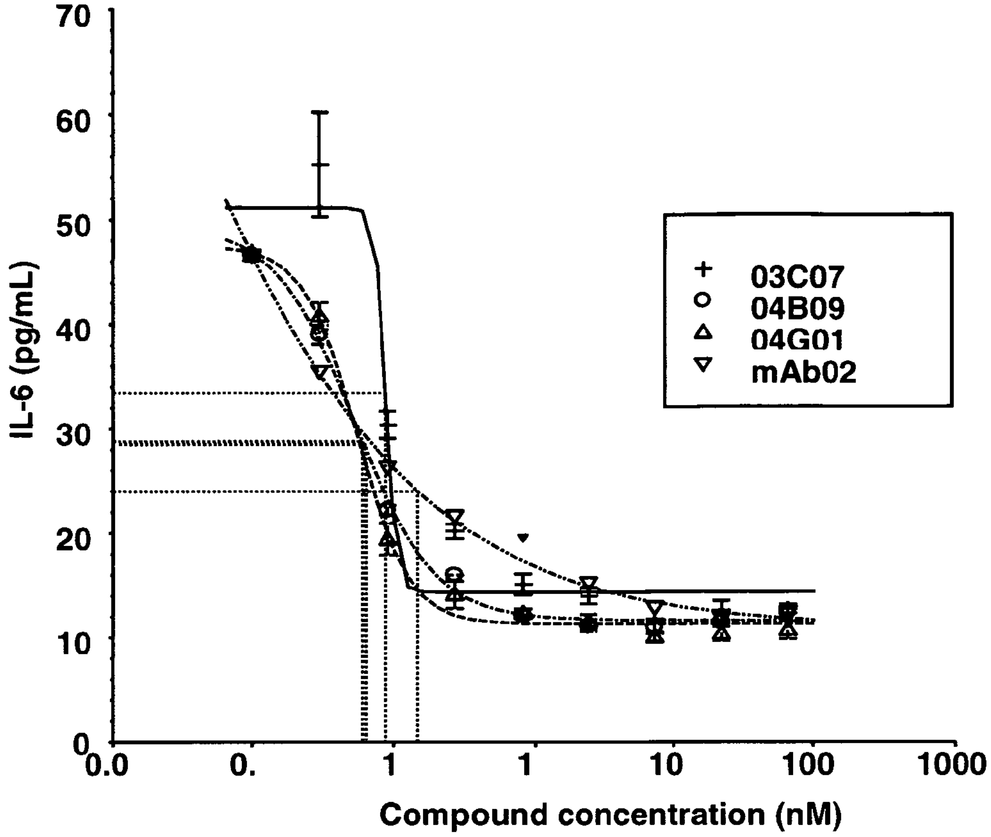

FIG. 2: IL-6 secretion by HT-1080 cells stimulated with IL-17A. Representative dose-response curves of IL-6 secretion by HT-1080 cells in the presence of 0.3 μg/mL recombinant human IL-17A and various concentrations of Nanobodies or reference compound mAb02. Results are shown as mean IL-6 secretion and STD.

Figure 3:
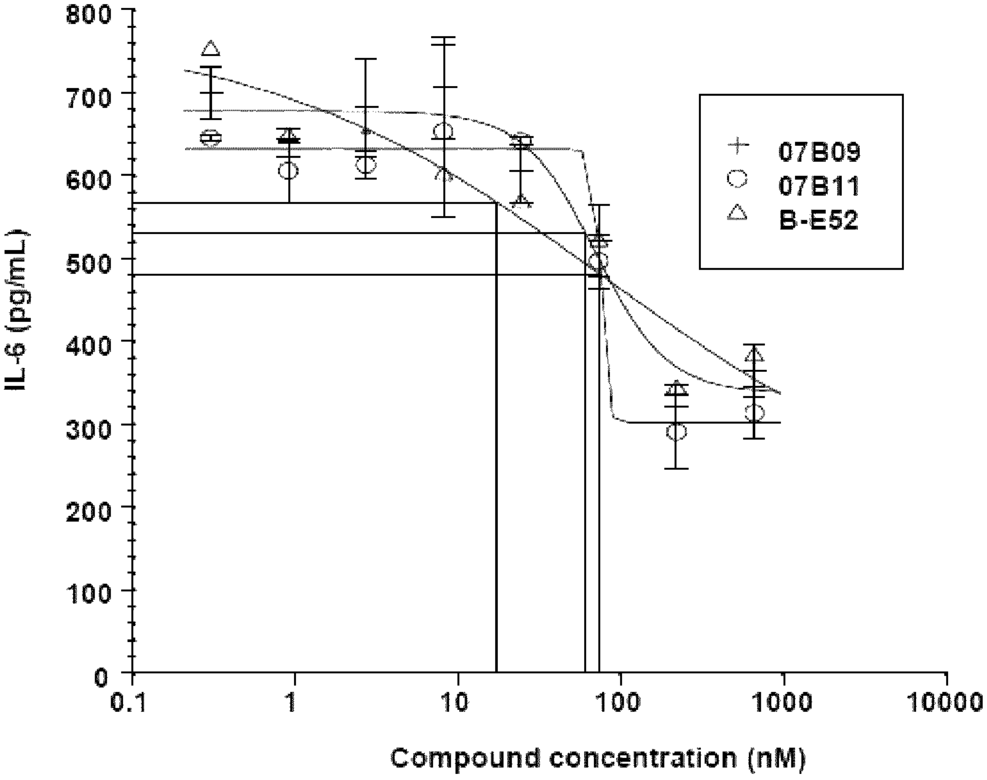

FIG. 3: IL-6 secretion by HT-1080 cells stimulated with IL-17F. Representative dose-response curves of IL-6 secretion by HT-1080 cells in the presence of 4.5 μg/mL recombinant human IL-17F and various concentrations of Nanobodies or reference compound mAb B-E52. Results are shown as mean IL-6 secretion and STD.

Figure 4:
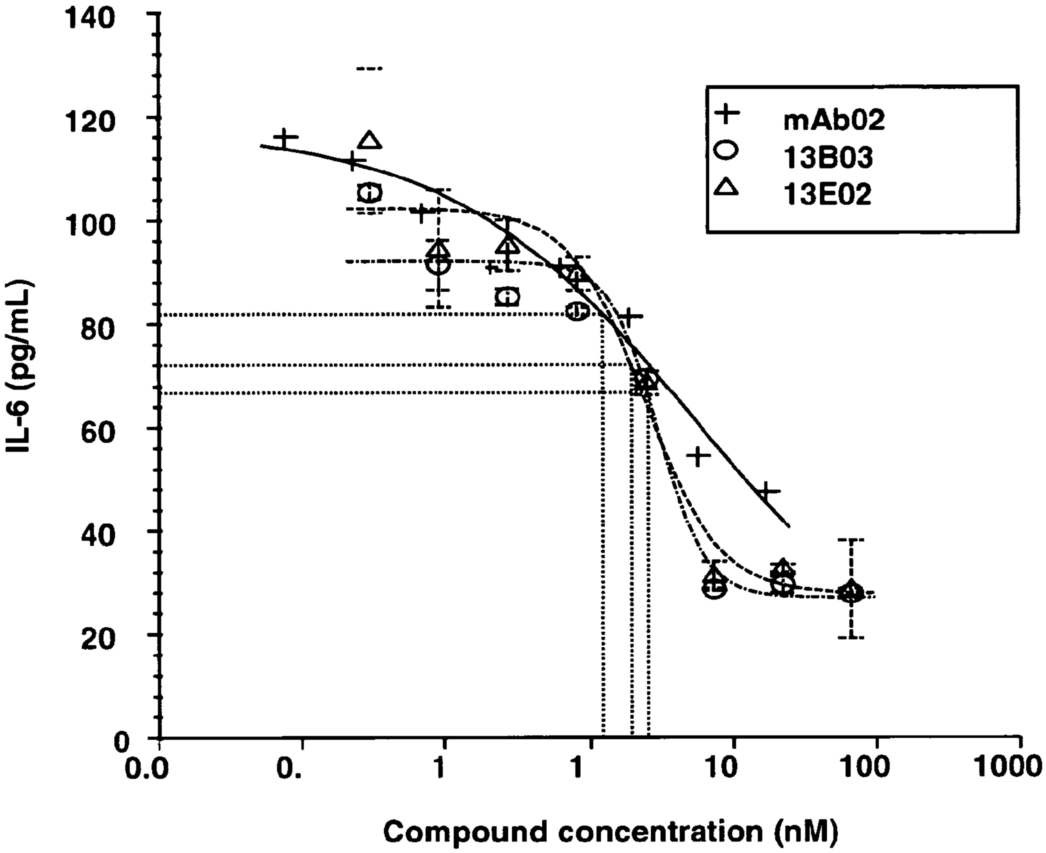

FIG. 4: IL-6 secretion by HT-1080 cells stimulated with IL-17A/F. Representative dose-response curves of IL-6 secretion by HT-1080 cells in the presence of 1.5 μg/mL recombinant human IL-17A/F and various concentrations of Nanobodies or reference compound mAb02. Results are shown as mean IL-6 secretion and STD.

FIG. 5: Amino acid sequences of Nanobodies from Class 1, Class 2, Class 3, and Class 4

FIG. 6: Amino acid sequences of some preferred, but non-limiting examples of polypeptides of the invention.

FIG. 7: Amino acid sequences of some preferred, but non-limiting examples of humanized and/or sequence-optimized amino acid sequences of the invention.

FIG. 8: Amino acid sequences of some preferred, but non-limiting examples of polypeptides of the invention that are based on humanized and/or sequence-optimized amino acid sequences of the invention.

FIG. 9: Amino acid sequences of some of the reagents and reference materials used in the Examples.

Figure 10:
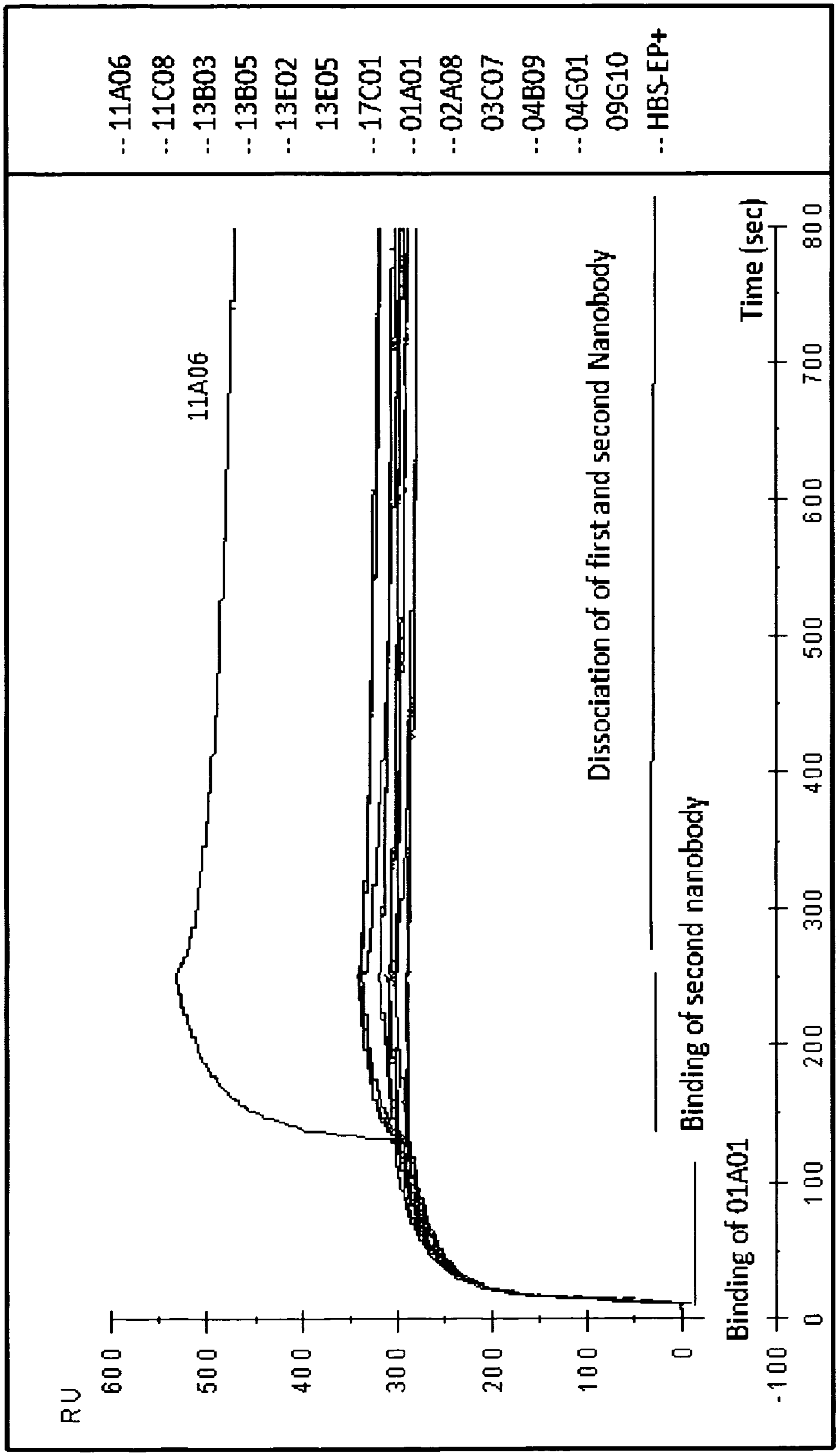

FIG. 10: Sensorgram of an epitope binning experiment, where IL17A was immobilized, 01A01 was bound and the binding of a second test Nanobody (see table on the right) was evaluated.

Figure 11:
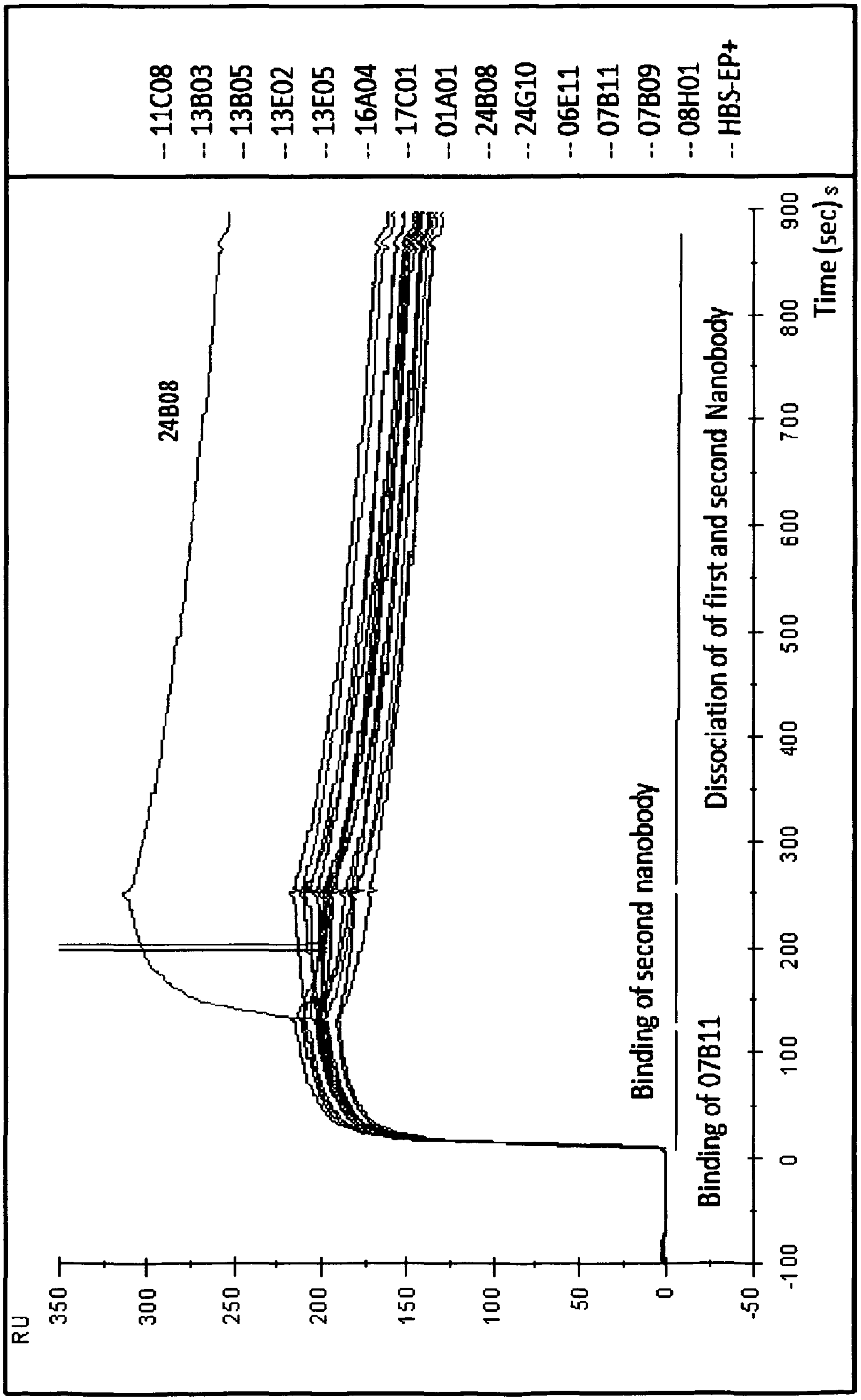

FIG. 11: Sensorgram of an epitope binning experiment, where IL17F was immobilized, 07B11 was bound and the binding of a second test Nanobody (see table on the right) was evaluated.

FIG. 12: Serum KC levels following subcutaneous administration of rhIL-17A (A) or rhIL-17F (B) in groups of 5 BALB/c mice previously administered intravenously with the indicated doses of the IL17MS3086 Nanobody, the reference positive controls mAb02 (A), mAb B-F60 (B), mAb03 (A,B) or negative Nanobody (ALB11) or antibody (hIgG1) controls (A,B). Results are expressed as mean±SEM per group. Statistical analyses were performed with One way ANOVA with Dunnet's post test and significant values are indicated. As used throughout this specification, "Alb11" refers to a nanobody that specifically binds to human serum albumin (HSA). ISVs comprising an Alb11 sequence have an extended biological half-life, i.e. a half life extension (HLE).

Figure 13:
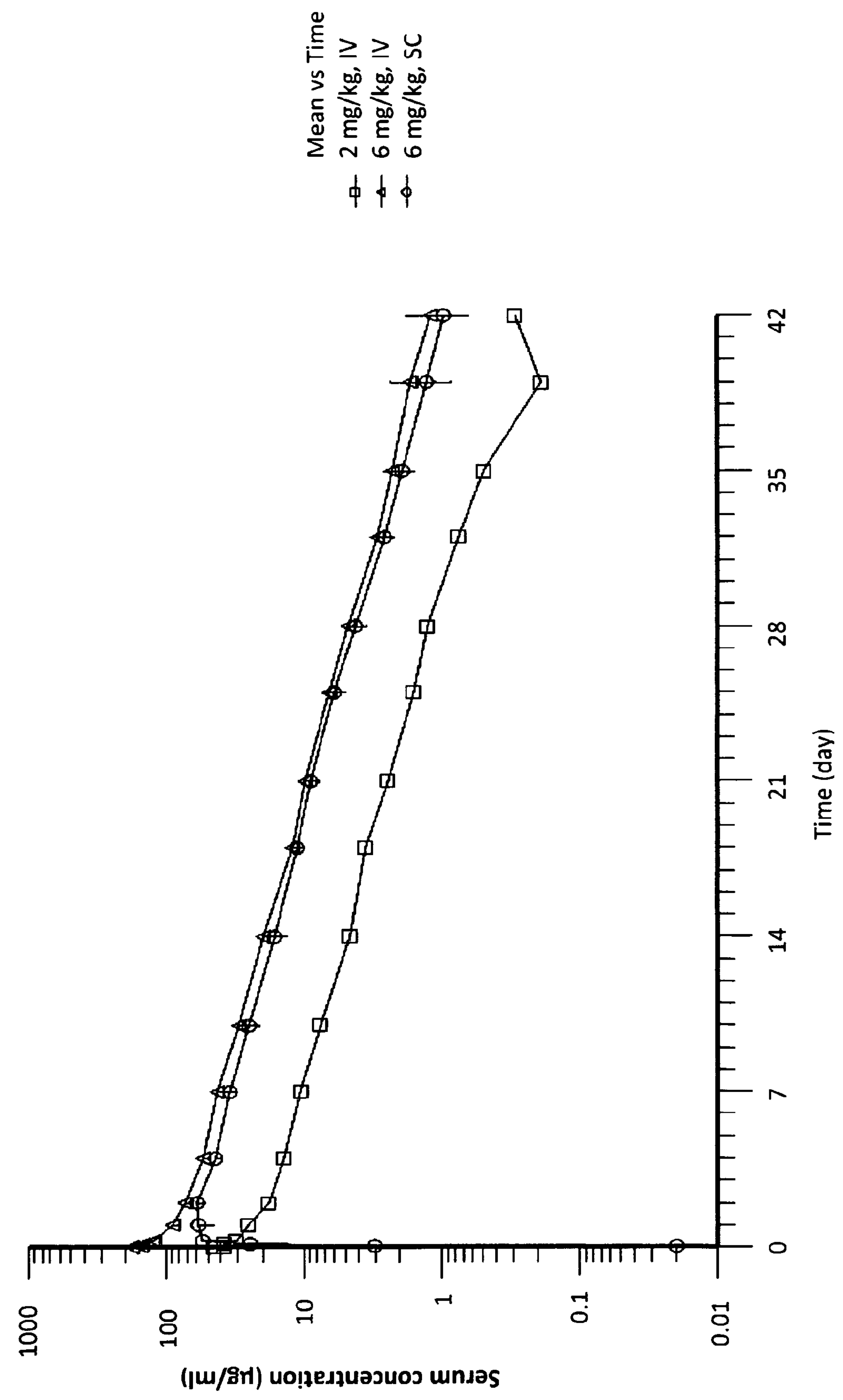

FIG. 13: Mean (with s.d. if n=3) serum concentration-time profiles of IL17MS3086 following a single i.v. bolus dose at 2 mg/kg (n=2) and 6 mg/kg (n=3) or a single s.c. dose at 6 mg/kg (n=3), respectively in the female cynomolgus monkey.

Figure 14:
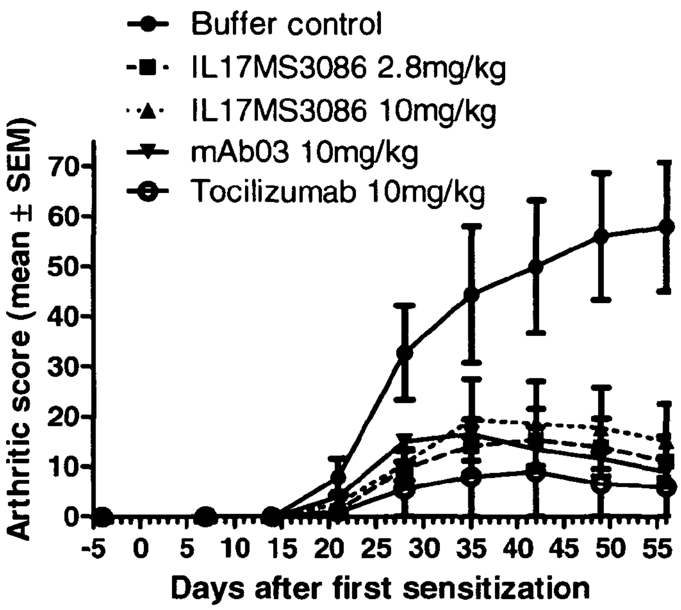

FIG. 14. Arthritis score of the study animals. 5-10 female cynomolgus monkeys per group were subcutaneously sensitized twice with bovine type II collagen in Freund's complete adjuvant and treated weekly with either IL17MS3086 (2.8 mg/kg and 10 mg/kg), mAb03 (10 mg/kg) or formulation buffer subcutaneously. An additional group (2 animals) received Tocilizumab at 10 mg/kg intravenously to serve as positive control. Arthritis of the joints was scored weekly until day 56 and are depicted as mean±SEM.

Figure 15:
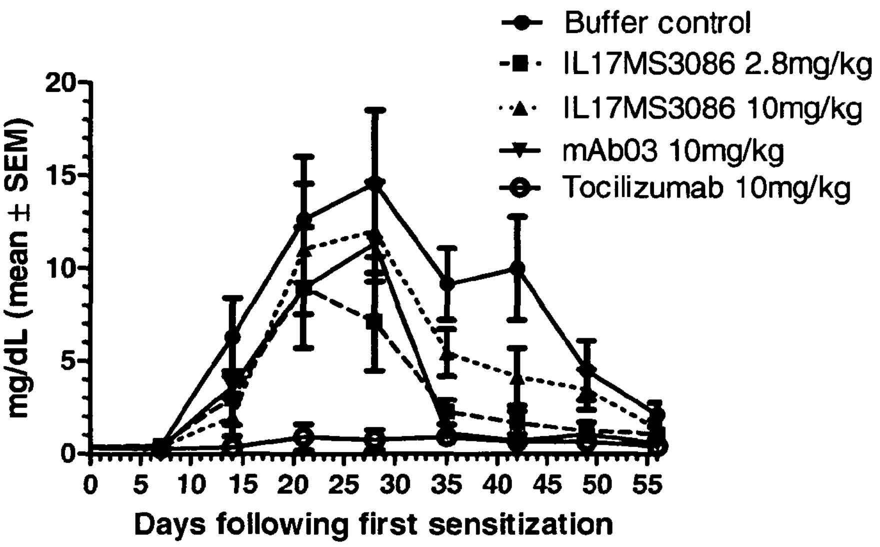

FIG. 15. Serum CRP levels in study animals. 5-10 female cynomolgus monkeys per group were subcutaneously sensitized twice with bovine type II collagen in Freund's complete adjuvant and treated weekly with either IL17MS3086 (2.8 mg/kg and 10 mg/kg), mAb03 (10 mg/kg) or formulation buffer subcutaneously. An additional group (2 animals) received Tocilizumab at 10 mg/kg intravenously to serve as positive control. Serum CRP levels were measured weekly until day 56 and are reported as mg/dL. The results are depicted as mean±SEM.

FIG. 16. Radiological evaluation of the hands and feet of study animals. 5-10 female cynomolgus monkeys per group were subcutaneously sensitized twice with bovine type II collagen in Freund's complete adjuvant and treated weekly with either IL17MS3086 (2.8 mg/kg and 10 mg/kg), mAb03 (10 mg/kg) or formulation buffer subcutaneously. An additional group (2 animals) received Tocilizumab at 10 mg/kg intravenously to serve as positive control. Joint space narrowing and atrophy (score A) (A) and bone erosion or architectural joint destruction accompanied by bone erosion (Score B) (B) was scored. The results are depicted as mean±SEM for each individual score.

Figure 17:
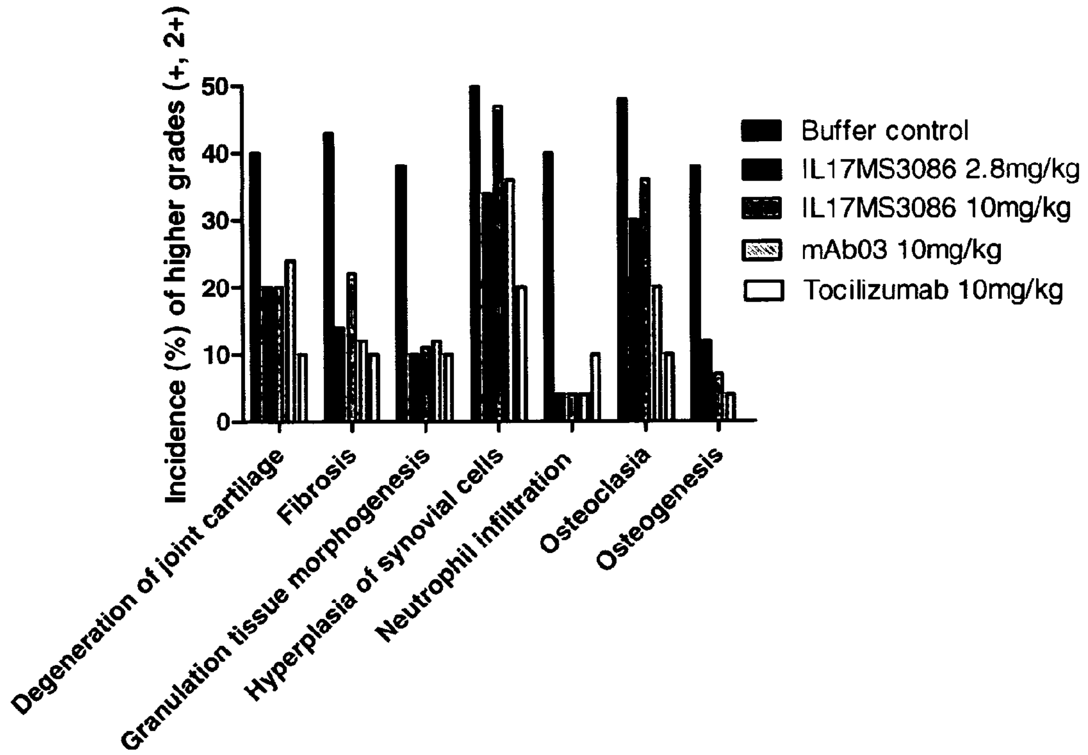

FIG. 17. Histological evaluation for all study animals. 5-10 female cynomolgus monkeys per group were subcutaneously sensitized twice with bovine type II collagen in Freund's complete adjuvant and treated weekly with either IL17MS3086 (2.8 mg/kg and 10 mg/kg), mAb03 (10 mg/kg) or formulation buffer subcutaneously. An additional group (2 animals) received Tocilizumab at 10 mg/kg intravenously to serve as positive control. Following necropsy on day 57, slide specimens of the right carpal and PIP joints were prepared by sectioning paraffin-embedded tissue and staining with Hematoxylin-Eosin and safranin-O. The incidence in percent of joints with higher grades for each parameter is depicted. Higher grades was defined as scores of + and 2+.

Figure 18:
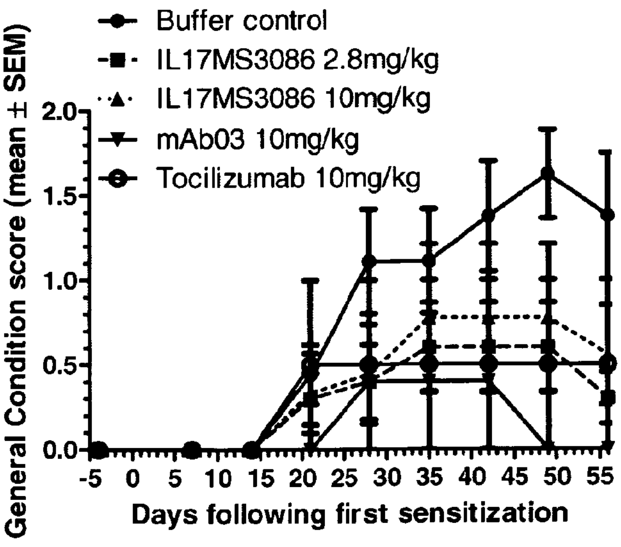

FIG. 18. General condition score for study animals. 5-10 female cynomolgus monkeys per group were subcutaneously sensitized twice with bovine type II collagen in Freund's complete adjuvant and treated weekly with either IL17MS3086 (2.8 mg/kg and 10 mg/kg), mAb03 (10 mg/kg) or formulation buffer subcutaneously. An additional group (2 animals) received Tocilizumab at 10 mg/kg intravenously to serve as positive control. The way the animals moved and hung to the bars of their cages was evaluated and scored weekly based on the criteria described in Table 40. The results are the mean±SEM for each group.

EXAMPLES

Example 1: Production and Purification of IL-17A and IL-17F Immunogens

Human IL-17A was expressed by transfection of Hek293 cells with plasmid DNA encoding the human secreted form of IL-17A (GenBank Acc. number U32659 and coding sequence in appendix) with a 6-His C-terminal extension. Briefly, cells in suspension in DMEM:F12 medium (Invitrogen) containing 4 ml/L Insulin-Transferrin-Selenium-X supplement (Invitrogen) and 1% Foetal Bovine Serum (Invitrogen) were incubated with a mixture of plasmid DNA and Poly-Ethylenelmine (PolySciences). After 90 min, transfected cells were diluted 1:1 in Freestyle medium (Invitrogen) and placed on an orbital shaker at 37° C. in a 5% CO2 incubator under agitation at 160 rpm. The supernatant was harvested after 6 days and sterile filtered through a 0.22 μm membrane cartridge (Millipore). The recombinant protein was purified on a Poros 20 MC metal chelate affinity chromatography column (Applied Biosystems) charged with Ni ions, followed by size exclusion chromatography in PBS on a HiLoad Superdex 75 prepgrade 16/60 column from GE Healthcare.

Human IL-17F (GenBank Acc. number AF384857 and coding sequence in appendix) was expressed as a 6-His C-terminal tagged protein and purified under the same conditions as described for human IL-17A.

Example 2: Immunization

Three llamas (346, 347 and 374) were immunized with recombinant human IL-17A with the aim to induce a heavy-chain antibody dependent humoral immune response. On day 0, 100 μg of antigen emulsified in Complete Freund's Adjuvant was administered via intramuscular injection in the neck. Three additional injections of respectively 50, 25 and 25 μg of antigen emulsified in Incomplete Freund's Adjuvant were administered every 2 weeks. Peripheral blood lymphocytes (PBLs) and the lymph node (LN) biopsy were collected 4 and 8 days after the last boost.

Similarly, three llamas (292, 293 and 399) were immunized with recombinant human IL-17F, and two llamas (190b and 344) were immunized with recombinant human IL-17A/F heterodimer which was produced in *E. coli* and purchased from R&D Systems (Cat No. 5194-IL/CF).

The humoral immune response was monitored during the immunization process by comparing the antigen specific serum titers of a sample collected prior to initiation of immunization (day 0) and a serum sample typically collected after three antigen administrations (day 35). Briefly, 96-well Maxisorp plates (Nunc, Wiesbaden, Germany) were coated with human IL-17A, IL-17F or IL-17A/F. After blocking and adding diluted serum samples, the presence of anti-IL-17 Nanobodies was demonstrated by using HRP (horseradish peroxidase) conjugated goat anti-llama immunoglobulin (Bethyl Laboratories Inc., Montgomery, Tex. USA) and a subsequent enzymatic reaction in the presence of the substrate TMB (3,3',5,5'-tetramentylbenzidine) (Pierce, Rockford, Ill., USA).

Example 3: Library Construction

Peripheral blood mononuclear cells were prepared from the blood samples using Ficoll-Hypaque according to the manufacturer's instructions. Total RNA extracted from these cells and from lymph nodes was used as starting material for RT-PCR to amplify Nanobody encoding gene fragments. These fragments were cloned into phagemid vector pAX50. Phage was prepared according to standard protocols (Phage Display of Peptides and Proteins: A Laboratory Manual, Academic Press; 1st edition (Oct. 28, 1996) Brian K. Kay, Jill Winter, John McCafferty) and stored after filter sterilization at 4° C. until further use. In total, 8 phage libraries were constructed (346, 347, 374, 292, 293, 399, 190b and 344), with library sizes between $4.5\times10^7$ and $5\times10^8$, and a percentage of insert ranging from 95 to 100%.

Example 4: Selections in Search of Anti-IL-17A, IL-17F and IL-17A/F Nanobodies To identify Nanobodies recognizing human and Cynomolgus monkey IL-17A and/or IL-17F and/or IL-17A/F, the phage libraries were incubated with soluble biotinylated IL-17 Cynomolgus monkey IL-17A and IL-17F were produced in Hek293 cells and purified as described in Example 1. Both proteins were expressed from plasmids bearing the coding sequences mentioned in the appendix with an additional 3' end in-frame 6-His-encoding nucleotide sequence.

Cynomolgus monkey IL-17A, Cynomolgus monkey IL-17F, human IL-17A, human IL-17F and human IL-17A/F were biotinylated using Sulfo-NHS-LC-Biotin (Pierce). Complexes of biotinylated IL-17 and phage were captured from solution on streptavidin coated magnetic beads. After extensive washing with PBS/0.05% Tween20, bound phage were eluted by addition of trypsin (1 mg/ml). The phage libraries 292, 293 and 399 were incubated with soluble biotinylated human and Cynomolgus IL-17A (100, 10 and 1 nM), phage libraries 346, 347 and 374 with soluble biotinylated human and Cynomolgus IL-17F (100, 10 and 1 nM) and phage libraries 190b and 344 with soluble biotinylated human IL-17A/F, Cynomolgus IL-17A and Cynomolgus IL-17F (100 and 1 nM). Outputs of these round 1 selections were analyzed for enrichment factor (number of phage present in eluate relative to controls) and individual clones from these first round outputs were picked.

To identify human IL-17F Nanobodies that bound with high affinity, phage libraries 292, 293 and 399 were incubated with low concentrations of soluble biotinylated hIL-17A/F (1000, 100, 10, 1 and 0.1 pM). Also from these outputs individual clones were picked. To specifically identify Nanobodies recognizing human IL-17A and IL-17F and IL-17A/F, two strategies were followed. In the first strategy, outputs of phage libraries 346, 347 and 374 selected on human and Cynomolgus IL-17A (100, 10 and 1 nM), were incubated with biotinylated hIL-17F (10-1 nM) and outputs of phage libraries 292, 293 and 399 selected on human and Cynomolgus IL-17F (100, 10 and 1 nM), were incubated with biotinylated hIL-17A (10-1 nM). In the second strategy, phage libraries 346, 347 and 374 were selected on biotinylated hIL-17F (10-1 nM) and phage libraries 292, 293 and 399 on biotinylated hIL-17A (10-1 nM) in two consecutive selections rounds using the same conditions. From these round 2 selections individual clones were picked.

All individual clones were grown in 96 deep well plates (1 ml volume). Nanobody expression was induced by adding IPTG to a final concentration of 1 mM. Periplasmic extracts were prepared by freezing the cell pellets and dissolving them in 100 μl PBS. Cell debris was removed by centrifugation. As a control, selected periplasmic extracts were screened in an ELISA for binding to hIL-17A, hIL-17F or hIL-17A/F. Briefly, neutravidin (1 μg/ml) was immobilized on polysorp microtiter plates (Nunc). Free binding sites were blocked using 4% Marvel in PBS. Biotinylated hIL-17 (10 nM) was incubated in 0.1% Marvel/PBS/0.05% Tween20 with 1/10 diluted periplasmic extracts, containing Nanobody of the different clones, for 1 hour and then captured via the immobilized neutravidin. After incubation and washing, Nanobody binding was detected using anti-c-Myc, followed by HRP-conjugated anti-mouse antibody and TMB substrate.

Example 5: Screening for Blocking Nanobodies in Periplasmic Extracts by AlphaScreen Assays Using Human IL-17A, IL-17F and IL-17A/F In order to determine the blocking capacity of the Nanobodies, periplasmic extracts were screened in protein-based competition assays using the AlphaScreen technology (PerkinElmer, Waltham, Mass. USA). AlphaScreen assays were set-up for the different combinations of IL-17A, IL-17F and IL-17A/F ligands with either IL-17RA or IL-17RC.

hIL-17A and hIL-17F produced in Hek293 cells and hIL-17A/F produced in *E. coli* were biotinylated using Sulfo-NHS-LC-Biotin (Pierce). Human IL-17RA-Fc (R&D Systems, and hIL-17RC-Fc chimera (produced in Hek293 cells as described in Example 1) were captured on anti-human Fc Nanobody coated Acceptor beads which were prepared according to the manufacturer's instructions (PerkinElmer). To evaluate the blocking capacity of anti-IL-17 Nanobodies, dilutions of the periplasmic extracts were pre-incubated with biotinylated hIL-17. To this mixture, IL-17R-Fc, Acceptor beads and the streptavidin-coupled Donor beads were added and further incubated for 1 hour at room temperature. Fluorescence was measured using the EnVision Multilabel Plate Reader (PerkinElmer) using an excitation wavelength of 680 nm and an emission wavelength of 520 nm. Decrease in the AlphaScreen signal indicates that the binding of biotinylated hIL-17 to the IL-17 receptor is blocked by the Nanobody present in the periplasmic extract.

Following this screening process, several Classes of Nanobodies were identified: 1) Nanobodies inhibiting the IL-17A but not the IL-17A/F interaction with both receptors, 2) Nanobodies inhibiting the IL-17A and IL-17A/F interaction with both receptors, 3) Nanobodies inhibiting the IL-17F interaction with both receptors, some of them also partially blocking IL-17A/F, and 4) Nanobodies inhibiting the IL-17A and IL-17F interactions with both receptors (called IL-17A and IL-17F cross-reactive Nanobodies) (Table 1).

TABLE 1

Nanobody classes identified during the screening procedure using AlphaScreen assays.

| | | AlphaScreen assay | | | | | |
|---|---|---|---|---|---|---|---|
| Nanobody Class | Properties | IL-17A-IL-17RA | IL-17A-IL-17RC | IL-17F-IL-17RA | IL-17F-IL-17RC | IL-17A/F-IL-17RA | IL-17A/F-IL-17RC |
| Class 1 | Anti-IL-17A | + | + | | | − | − |
| Class 2 | Anti-IL-17A and IL-17A/F | + | + | | | + | + |
| Class 3 | Anti-IL-17F type 1 | | | + | + | − | − |
| | Anti-IL-17F type 2 | | | + | + | + | − |
| | Anti-IL-17F type 3 | | | + | + | − | + |
| Class 4 | Cross-reactive: Anti-IL-17A, IL-17F and IL-17A/F | + | | | + | + | + |

(+ = blocking; − = non-blocking; blank = not tested)

Example 6: Surface Plasmon Resonance Analysis of Periplasmic Extracts on IL-17A, IL-17F and IL-17A/F Off-rates of the periplasmic extracts containing anti-IL-17 Nanobodies were measured by Surface Plasmon Resonance (SPR) using a Biacore T100 instrument. Human IL-17A, IL-17F or IL-17A/F was covalently bound to a CM sensor chip surface via amine coupling using EDC/NHS for activation and HCl for deactivation. Periplasmic extracts containing IL-17 neutralizing Nanobodies were injected for 2 minutes at a flow rate of 45 μl/min to allow binding to chip-bound antigen. Next, binding buffer without periplasmic extracts was sent over the chip at the same flow rate to allow spontaneous dissociation of bound Nanobody. From the sensorgrams obtained for the different periplasmic extracts $k_{off}$-values ($k_d$) were calculated. Based on this Biacore analysis, a set of IL-17 Nanobodies with the best off-rates was selected and sequenced. Sequencing analysis revealed 63 different families of anti-IL-17 neutralizing Nanobodies (Table 2). FIG. 5 depicts selected sequences of Class 1 to Class 4 Nanobodies.

TABLE 2

Number of Nanobody families per anti-IL-17 Nanobody type

| Nanobody Class | Description | Number of families |
|---|---|---|
| Class 1 | Anti-IL-17A | 14 |
| Class 2 | Anti-IL-17A and IL-17A/F | 22 |
| Class 3 | Anti-IL-17F | 18 |
| Class 4 | Cross-reactive: Anti-IL-17A, IL-17F and IL-17A/F | 9 |

The periplasmic extracts containing Nanobodies from Class 1, Class 2, Class 3 and Class 4 were also screened for cross-reactivity towards Cynomolgus monkey IL-17, by determining off-rates on immobilized Cynomolgus monkey IL-17A and IL-17F. All tested extracts containing Nanobodies from Class 1, Class 2 and Class 4 also showed binding to Cynomolgus monkey IL-17A and the ones from Class 3 and 4 showed binding to Cynomolgus monkey IL-17F.

Example 7: Expression and Purification of Anti-IL-17A, IL-17F and IL-17A/F Nanobodies from Various Classes Five of the Class 1 Nanobodies, 12 of the Class 2 Nanobodies, 10 of the Class 3 Nanobodies and 9 of the Class 4 cross-reactive Nanobodies were selected for expression and purification, based on their blocking capacity in AlphaScreen assays and off-rate values. Sequences are shown in FIG. 5.

Nanobodies were expressed in *E. coli* TG1 cells as c-myc, His6-tagged proteins in a culture volume of 500 mL. Expression was induced by addition of 1 mM IPTG and allowed to continue for 3 h at 37° C. After spinning the cell cultures, periplasmic extracts were prepared by freeze-thawing the pellets and resuspension in dPBS. These extracts were used as starting material for immobilized metal affinity chromatography (IMAC) using Histrap FF crude columns (GE Healthcare). Nanobodies were eluted from the column with 250 mM imidazole and subsequently desalted towards dPBS. For the cell based assays described below, endotoxins were removed by gel filtration in the presence of 50 mM Octylβ-D-glucopyranoside (OGP, Sigma). Endotoxin levels were determined using a standard LAL-assay.

Example 8: Blocking Capacity of Purified Nanobodies in AlphaScreen Assays Using Human IL-17A, IL-17F and IL-17A/F Blocking capacity of 36 purified Nanobodies belonging to 4 different Classes, as described in Example 7, was determined in AlphaScreen protein-based competition assays for all possible interactions between the human ligands IL-17A, IL-17F and IL-17-A/F and human receptors IL-17RA and IL-17RC. A dilution series of each Nanobody starting from 250 nM down to 1 pM was pre-incubated with biotinylated hIL-17 ligand during 15 minutes at room temperature (RT). The concentration of the ligand used in the different assay set-ups is listed in Table 3. To this mixture, the IL-17RA or IL-17RC Fc-fusions, Acceptor beads and the streptavidin Donor beads were added and further incubated for 1 hour at RT. A dose-dependent decrease of the fluorescence intensity at 520 nm was observed for Nanobodies that blocked a specific ligand-receptor interaction, and the IC50 value could be determined for each blocking Nanobody (Table 4). An exemplary graph illustrating the blocking capacity of a selection of anti-IL-17 Nanobodies for the IL-17A-IL-17RA interaction is shown in FIG. 1. An anti-IL-17A and IL-17A/F specific Fab fragment Fab01 was included as positive control.

TABLE 3

Overview of the concentrations of IL-17 ligand and IL-17 receptors used in the AlphaScreen assays to determine IC50 values of the Nanobodies

| Assay set-up Ligand-receptor combination | Concentration ligand (nM) | Concentration receptor (nM) |
|---|---|---|
| IL-17A - IL-17RA | 0.26 | 0.26 |
| IL-17A - IL-17RC | 0.64 | 0.64 |
| IL-17F - IL-17RA | 1.60 | 0.64 |
| IL-17F - IL-17RC | 0.10 | 0.26 |
| IL-17A/F - IL-17RA | 0.64 | 1.60 |
| IL-17A/F - IL-17RC | 0.10 | 0.26 |

TABLE 4

IC50 values for the various blocking anti-IL-17 Nanobodies as determined in the different AlphaScreen assays.

| Nanobody | Nanobody Class | IL-17A-IL-17RA (IC50 in pM) | IL-17A-IL-17RC (IC50 in pM) | IL-17F-IL-17RA (IC50 in pM) | IL-17F-IL-17RC (IC50 in pM) | IL-17A/F-IL-17RA (IC50 in pM) | IL-17A/F-IL-17RC (IC50 in pM) |
|---|---|---|---|---|---|---|---|
| 01D02 | Class 1 | 130 | 363 | nb | nb | 71660 | 94650 |
| 01G03 | Class 1 | 325 | 1147 | nb | nb | nb | nb |
| 02E03 | Class 1 | 256 | 778 | nb | nb | nb | >250000 |
| 03B08 | Class 1 | 80 | 384 | nb | nb | nb | nb |
| 03E05 | Class 1 | 58 | 380 | nb | nb | >250000 | nb |
| 01D06 | Class 2 | 618 | 1521 | nb | nb | 401 | 198 |
| 02A08 | Class 2 | 126 | 419 | >250000 | >250000 | 170 | 87 |
| 02A10 | Class 2 | 115 | 381 | nb | nb | 199 | 248 |
| 03C07 | Class 2 | 84 | 371 | nb | nb | 366 | 565 |
| 04A02 | Class 2 | 399 | 837 | nb | nb | 1960 | 3173 |
| 04B09 | Class 2 | 67 | 252 | nb | nb | 121 | 169 |
| 04B10 | Class 2 | 68 | 366 | nb | nb | 95 | 52 |
| 04F09 | Class 2 | 99 | 468 | nb | nb | 3978 | 3149 |
| 04G01 | Class 2 | 14 | 217 | nb | nb | 67 | 39 |
| 09D10 | Class 2 | 211 | 1122 | nb | 69400 | 9020 | 8655 |
| 09G10 | Class 2 | 46 | 323 | nb | nb | 101 | 120 |
| 11A06 | Class 2 | 81 | 461 | nb | >250000 | 140 | 39 |
| 06E11 | Class 3 | nb | nb | 799 | 71 | nb | 952 |
| 07B09 | Class 3 | nb | nb | 614 | 19 | partial | 89 |
| 07B11 | Class 3 | nb | nb | 1104 | 15 | partial | 58 |
| 08A08 | Class 3 | nb | nb | 3843 | 1297 | nb | 19660 |
| 08B07 | Class 3 | nb | nb | 761 | 108 | >250000 | nb |
| 08H01 | Class 3 | nb | nb | 323 | 33 | partial | 259 |
| 12A09 | Class 3 | nb | nb | 1842 | 612 | >250000 | 33210 |
| 16A04 | Class 3 | >77870 | >131000 | 1093 | 52 | 90360 | 389 |
| 24B08 | Class 3 | nb | nb | 491 | 42 | 138 | partial |
| 24G10 | Class 3 | nb | nb | 476 | 23 | partial | 47 |
| 01A01 | Class 4 | 51 | 211 | 16180 | 13500 | 102 | 46 |
| 10A04 | Class 4 | 78140 | >250000 | 746 | 220 | 37740 | 15640 |

TABLE 4-continued

IC50 values for the various blocking anti-IL-17 Nanobodies as determined in the different AlphaScreen assays.

| Nanobody | Nanobody Class | IL-17A-IL-17RA (IC50 in pM) | IL-17A-IL-17RC (IC50 in pM) | IL-17F-IL-17RA (IC50 in pM) | IL-17F-IL-17RC (IC50 in pM) | IL-17A/F-IL-17RA (IC50 in pM) | IL-17A/F-IL-17RC (IC50 in pM) |
|---|---|---|---|---|---|---|---|
| 11C08 | Class 4 | 2119 | 4798 | 2255 | 488 | 3252 | 1162 |
| 13B03 | Class 4 | 56 | 202 | 2114 | 848 | 79 | 31 |
| 13B05 | Class 4 | 118 | 249 | 719 | 603 | 464 | 944 |
| 13E02 | Class 4 | 67 | 187 | 395 | 214 | 71 | 117 |
| 13E05 | Class 4 | 159 | 1091 | 1100 | 286 | 862 | 315 |
| 17C01 | Class 4 | 66 | 169 | 296 | 168 | 264 | 801 |
| 18B05 | Class 4 | 173 | 408 | 36640 | 13260 | 231 | 87 |
| Fab01 | N/A | 787 | 1115 | nb | nb | 2736 | 5842 |

nb: non-blocking;
N/A: not applicable

Example 9: Blocking Activity of Purified Nanobodies in Cell-Based Assays Using IL-17A, IL-17F and IL-17A/F The blocking capacity of the purified Nanobodies was also assessed using the HT-1080 cell-based assay, in which dose-dependent inhibition of hIL-17A, hIL-17F or hIL-17A/F induced IL-6 secretion by the HT-1080 cells is investigated. The experimental protocol was as follows: Human HT-1080 fibrosarcoma cells (ATCC reference CCL-121) were grown in Dulbecco's Minimum Essential Medium (DMEM) supplemented with 10% Fetal Bovine Serum (FBS) and 1% penicillin-streptomycin solution (P-S), referred as Complete Medium at 37° C. with 5% $CO_2$. For cell production and weekly passage, cells were seeded at $2\times10^4$ cells/$cm^2$ into T75 culture flasks.

For in vitro stimulation assays, $3\times10^4$ HT-1080 cells in 100 μL DMEM plus 2.5% FBS and 0.25% P-S were distributed to flat-bottom 96-well plates and incubated overnight. On the day of the stimulation, 80 μL of the medium was replaced. Seven serial 1:3 dilutions of Nanobodies or anti-IL-17A mAb02 reference compound were performed in PBS from a starting concentration of 100 μg/mL, and 10 μL of each Nanobody or mAb02 diluted solution were added per well of HT-1080 cells in duplicate for Nanobodies and quadruplicate for mAb02. Final concentrations of Nanobodies or reference compound mAb02 ranged between 10 μg/mL and 0.0045 μg/mL. Seven serial 1:3 dilutions of anti-IL-17F mAb reference compound mAb B-E52 (Diaclone, Besançon, France) were performed in PBS from a starting concentration of 500 μg/mL, and 10 μL of each mAb B-E52 diluted solution were added per well of HT-1080 cells. Final concentrations of reference compound mAb B-E52 ranged between 100 μg/mL and 0.045 μg/mL. Control wells for stimulus alone or vehicle alone received 10 μL PBS, in quadruplicate.

Plates were incubated for 30 min. at 37° C. with 5% $CO_2$ before adding specific stimuli. For stimulation with human IL-17A, 10 μL of a solution of recombinant human IL-17A at 3 μg/mL in PBS (final concentration of IL-17A: 0.3 μg/mL) were added per each corresponding well. For stimulation with human IL-17F, 10 μL of a solution of recombinant human IL-17F at 45 μg/mL in PBS (final concentration of IL-17F: 4.5 μg/mL) were added per each corresponding well. For stimulation with human IL-17A/F, 10 μL of a solution of recombinant human IL-17A/F at 15 μg/mL in PBS (final concentration of IL-17A/F: 1.5 μg/mL) were added per each corresponding well. Negative control wells for vehicle alone receive 10 μL PBS.

Plates were incubated for 24 hours at 37° C. with 5% CO2. Supernatants were harvested, transferred into 96-well plates, and stored at −80° C. Levels of human IL-6 in 1:3 or 1:4 diluted supernatants (diluent is PBS plus 1% Bovine Serum Albumin) were determined using a commercial IL-6 ELISA assay (Human Duoset IL-6 ELISA, R&D Systems, Abingdon, UK) following the manufacturer's instructions. Optical density reading (OD) at 450 nM was performed using a Fluostar OPTIMA reader (BMG Labtech, Offenburg, Germany) and IL-6 concentration for each sample extrapolated from a four-parameter logistic curve fit calculated using OD readings from the internal IL-6 standards.

For data analyses, the molar mass of Nanobody compounds was estimated at 15 kDa for each Nanobody. The molecular mass of reference mAbs was estimated at 150 kDa. IC50 and Emax were calculated for each experiment from paired data compound concentration/IL-6 concentration using the XLFit software (ID Business Solutions, Guilford, UK) and a four-parameter log fit as given by the following formula: y=A+((B−A)/(1+((C/x)^D))) where A is the Minimum y, B the Maximum y, C is Log IC50, and D the Slope Factor. Mean IC50, Emax and respective STD for each compound across multiple experiments was calculated using XLFit.

As shown in FIG. 2 and Table 5, the Class 1, Class 2 and Class 4 Nanobodies as well as the reference compound mAb02 inhibited IL-6 secretion in HT-1080 cells induced by IL-17A in a concentration-dependent manner.

As shown in FIG. 3 and Table 6, the Class 3 and Class 4 Nanobodies (with the exception of 17C01 and 18B05), as well as the reference compound B-E52 inhibited IL-6 secretion in HT-1080 cells induced by IL-17F in a concentration-dependent manner.

As shown in FIG. 4 and Table 7, the Class 2, Class 3 (with the exception of 08A08 and 08B07) and Class 4 Nanobodies as well as the reference compound mAb02 inhibited IL-6 secretion in HT-1080 cells induced by IL-17A/F in a concentration-dependent manner.

TABLE 5

Inhibition of IL-17A-induced IL-6 production in human fibrosarcoma HT-1080 cells by anti-IL-17 monovalent Nanobodies and reference compounds.

| Nanobody | Nanobody Class | Stimulus IL-17A IC50 (nM) | Emax (%) | N |
|---|---|---|---|---|
| 02E03 | Class 1 | 16.4 ± 9 | 99.3 ± 5 | 3 |
| 03E05 | Class 1 | 4.0 ± 3 | 100.0 ± 6 | 2 |
| 01D02 | Class 1 | 4.8 ± 3 | 101.0 ± 6 | 2 |
| 01G03 | Class 1 | 68.3 ± 33 | 85.7 ± 5 | 3 |
| 03B08 | Class 1 | 3.6 ± 3 | 98.5 ± 5 | 2 |
| 02A08 | Class 2 | 8.8 ± 7 | 102.7 ± 10 | 3 |
| 03C07 | Class 2 | 4.2 ± 4 | 101.0 ± 6 | 3 |
| 04B09 | Class 2 | 3.2 ± 3 | 105.7 ± 6 | 3 |
| 04G01 | Class 2 | 5.4 ± 7 | 112.7 ± 9 | 3 |
| 09G10 | Class 2 | 4.0 ± 3 | 99.0 ± 0 | 2 |
| 11A06 | Class 2 | 4.0 ± 3 | 98.5 ± 2 | 2 |
| 01D06 | Class 2 | 42.8 ± 38 | 98.3 ± 5 | 3 |
| 02A10 | Class 2 | 4.3 ± 4 | 103.7 ± 9 | 3 |
| 04A02 | Class 2 | 12.6 ± 10 | 102 ± 7 | 3 |
| 04B10 | Class 2 | 5.1 ± 4 | 99.7 ± 12 | 3 |
| 04F09 | Class 2 | 9.7 ± 10 | 111.3 ± 13 | 3 |
| 09D10 | Class 2 | 8.5 ± 5 | 93.5 ± 1 | 2 |
| 06E11 | Class 3 | NI | NI | 2 |
| 07B09 | Class 3 | NI | NI | 2 |
| 07B11 | Class 3 | NI | NI | 2 |
| 08H01 | Class 3 | NI | NI | 2 |
| 16A04 | Class 3 | NI | NI | 2 |
| 24B08 | Class 3 | NI | NI | 2 |
| 24G10 | Class 3 | NI | NI | 2 |
| 08A08 | Class 3 | NI | NI | 2 |
| 08B07 | Class 3 | NI | NI | 2 |
| 12A09 | Class 3 | NI | NI | 2 |
| 01A01 | Class 4 | 2.7 ± 2 | 104.0 ± 10 | 3 |
| 11C08 | Class 4 | 130.1 ± 64 | 73.0 ± 1 | 2 |
| 13B03 | Class 4 | 2.9 ± 1 | 101.0 ± 0 | 2 |
| 13B05 | Class 4 | 14.0 ± 3 | 104.0 ± 6 | 4 |
| 13E02 | Class 4 | 3.5 ± 2 | 102.5 ± 2 | 2 |
| 13E05 | Class 4 | 12.3 ± 1 | 101.0 ± 7 | 2 |
| 17C01 | Class 4 | 15.1 ± 5 | 104.8 ± 4 | 4 |
| 10A04 | Class 4 | 65.4 ± 17 | 31.5 ± 6 | 2 |
| 18B05 | Class 4 | 20.6 ± 21 | 103.7 ± 3 | 3 |
| mAb02 | N/A | 3.9 ± 4 | 99.1 ± 5 | 20 |
| mAb B-E52 | N/A | NI | NI | 2 |

Results expressed as mean ± SD of N experiments.
NI: no inhibition observed;
N/A: not applicable

TABLE 6

Inhibition of IL-17F-induced IL-6 production in human fibrosarcoma HT-1080 cells by anti-IL-17 monovalent Nanobodies and reference compounds.

| Nanobody | Nanobody Class | Stimulus IL-17F IC50 (nM) | Emax (%) | N |
|---|---|---|---|---|
| 02E03 | Class 1 | NI | NI | 3 |
| 03E05 | Class 1 | NI | NI | 2 |
| 01D02 | Class 1 | NI | NI | 2 |
| 01G03 | Class 1 | NI | NI | 3 |
| 03B08 | Class 1 | NI | NI | 2 |
| 02A08 | Class 2 | NI | NI | 2 |
| 03C07 | Class 2 | NI | NI | 2 |
| 04B09 | Class 2 | NI | NI | 2 |
| 04G01 | Class 2 | NI | NI | 2 |
| 09G10 | Class 2 | NI | NI | 2 |
| 11A06 | Class 2 | NI | NI | 2 |
| 01D06 | Class 2 | NI | NI | 2 |
| 02A10 | Class 2 | NI | NI | 2 |
| 04A02 | Class 2 | NI | NI | 2 |
| 04B10 | Class 2 | NI | NI | 2 |
| 04F09 | Class 2 | NI | NI | 2 |
| 09D10 | Class 2 | NI | NI | 2 |

TABLE 6-continued

Inhibition of IL-17F-induced IL-6 production in human fibrosarcoma HT-1080 cells by anti-IL-17 monovalent Nanobodies and reference compounds.

| Nanobody | Nanobody Class | Stimulus IL-17F IC50 (nM) | Emax (%) | N |
|---|---|---|---|---|
| 06E11 | Class 3 | 88.0 ± 20 | 70.5 ± 6 | 2 |
| 07B09 | Class 3 | 75.1 ± 15 | 71.8 ± 12 | 4 |
| 07B11 | Class 3 | 57.5 ± 23 | 67.0 ± 14 | 2 |
| 08H01 | Class 3 | 85.5 ± 16 | 71.5 ± 1 | 2 |
| 16A04 | Class 3 | 112.4 ± 22 | 100.0 ± 6 | 4 |
| 24B08 | Class 3 | 141.4 ± 43 | 84.3 ± 9 | 4 |
| 24G10 | Class 3 | 90.6 ± 17 | 78.8 ± 7 | 4 |
| 08A08 | Class 3 | 206.0 ± 105 | 62.0 ± 8 | 2 |
| 08B07 | Class 3 | 174.5 ± 23 | 77.0 ± 14 | 2 |
| 12A09 | Class 3 | 105.2 ± 28 | 91.0 ± 10 | 2 |
| 01A01 | Class 4 | 206.2 ± 87 | 47.2 ± 12 | 3 |
| 11C08 | Class 4 | 222.6 ± 86 | 84.5 ± 15 | 2 |
| 13B03 | Class 4 | 149.2 ± 38 | 85.5 ± 11 | 2 |
| 13B05 | Class 4 | 249.0 ± 137 | 43.0 ± 8 | 4 |
| 13E02 | Class 4 | 103.6 ± 15 | 86.5 ± 11 | 2 |
| 13E05 | Class 4 | 115.0 ± 9 | 123.5 ± 22 | 2 |
| 17C01 | Class 4 | NI | NI | 4 |
| 10A04 | Class 4 | 111.9 ± 14 | 102.0 ± 10 | 2 |
| 18B05 | Class 4 | NI | NI | 3 |
| mAb02 | N/A | NI | NI | 2 |
| mAb B-E52 | N/A | 62.4 ± 27 | 84.0 ± 11 | 20 |

Results expressed as mean ± SD of N experiments.
NI: no inhibition observed;
N/A: not applicable

TABLE 7

Inhibition of IL-17A/F-induced IL-6 production in human fibrosarcoma HT-1080 by anti-IL-17 monovalent Nanobodies and reference compounds.

| Nanobody | Nanobody Class | Stimulus IL-17A/F IC50 (nM) | Emax (%) | N |
|---|---|---|---|---|
| 02E03 | Class 1 | NI | NI | 3 |
| 03E05 | Class 1 | NI | NI | 2 |
| 01D02 | Class 1 | NI | NI | 2 |
| 01G03 | Class 1 | NI | NI | 3 |
| 03B08 | Class 1 | NI | NI | 2 |
| 02A08 | Class 2 | 26.2 ± 16 | 109.0 ± 1 | 2 |
| 03C07 | Class 2 | 27.8 ± 17 | 102.0 ± 3 | 2 |
| 04B09 | Class 2 | 22.7 ± 10 | 102.0 ± 17 | 2 |
| 04G01 | Class 2 | 34.7 ± 0.5 | 104.5 ± 2 | 2 |
| 09G10 | Class 2 | 22.2 ± 0.1 | 107.5 ± 25 | 2 |
| 11A06 | Class 2 | 28.1 ± 8 | 106.5 ± 9 | 2 |
| 01D06 | Class 2 | 51.1 ± 0.2 | 79.5 ± 23 | 2 |
| 02A10 | Class 2 | 29.2 ± 16 | 98.5 ± 9 | 2 |
| 04A02 | Class 2 | 70.4 ± 4 | 67.6 ± 23 | 2 |
| 04B10 | Class 2 | 59.2 ± 13 | 97.0 ± 23 | 2 |
| 04F09 | Class 2 | 45.9 ± 37 | 68.5 ± 6 | 2 |
| 09D10 | Class 2 | 124.4 ± 131 | 55.0 ± 7 | 2 |
| 06E11 | Class 3 | 7.2 ± 5 | 57.5 ± 4 | 4 |
| 07B09 | Class 3 | 12.4 ± 9 | 70.3 ± 6 | 4 |
| 07B11 | Class 3 | 15.1 ± 13 | 71.0 ± 1 | 2 |
| 08H01 | Class 3 | 15.9 ± 14 | 62.5 ± 4 | 2 |
| 16A04 | Class 3 | 48.2 ± 32 | 95.0 ± 10 | 4 |
| 24B08 | Class 3 | 18.1 ± 11 | 50.5 ± 18 | 4 |
| 24G10 | Class 3 | 28.9 ± 14 | 72.8 ± 14 | 4 |
| 08A08 | Class 3 | NI | NI | 2 |
| 08B07 | Class 3 | NI | NI | 2 |
| 12A09 | Class 3 | 100.5 ± 108 | 41.5 ± 4 | 2 |
| 01A01 | Class 4 | 27.8 ± 17 | 102.0 ± 3 | 2 |
| 11C08 | Class 4 | 91.2 ± 4 | 89.5 ± 13 | 2 |
| 13B03 | Class 4 | 26.8 ± 3 | 112.5 ± 13 | 2 |
| 13B05 | Class 4 | 35.5 ± 15 | 108.5 ± 7 | 4 |
| 13E02 | Class 4 | 21.7 ± 4 | 108.5 ± 11 | 2 |
| 13E05 | Class 4 | 26.0 ± 9 | 159.5 ± 35 | 2 |
| 17C01 | Class 4 | 41.8 ± 25 | 107.3 ± 12 | 2 |

TABLE 7-continued

Inhibition of IL-17A/F-induced IL-6 production in human fibrosarcoma HT-1080 by anti-IL-17 monovalent Nanobodies and reference compounds.

| Nanobody | Nanobody Class | Stimulus IL-17A/F IC50 (nM) | Emax (%) | N |
|---|---|---|---|---|
| 10A04 | Class 4 | 122.1 ± 19 | 79.5 ± 18 | 2 |
| 18B05 | Class 4 | 37.1 ± 4 | 118.0 ± 1 | 3 |
| mAb02 | N/A | 18.4 ± 11 | 91.3 ± 12 | 17 |

Results expressed as mean ± SD of N experiments.
NI: no inhibition observed;
ND: not done;
N/A: not applicable

Example 10: SPR Analysis of Purified Nanobodies on IL-17A, IL-17F and IL-17A/F Off-rates of the anti-IL-17 Nanobodies showing the best potencies in AlphaScreen assays and in the cellular assays were measured by SPR using a Biacore T100 instrument as described in Example 6. From the sensorgrams obtained for the different Nanobodies $k_{on}$-values were calculated and are indicated in Table 8.

TABLE 8

Off-rates for human IL-17 binding of the anti-IL-17 Nanobodies as determined in Biacore.

| Nanobody Class | Nanobody | koff for hIL-17A (s−1) | koff for hIL-17F (s−1) | koff for hIL-17A/F (s−1) |
|---|---|---|---|---|
| Class 1 | 01D02 | 4.4E−04* | NB* | NB* |
| Class 1 | 01G03 | 4.5E−04* | NB* | NB* |
| Class 1 | 02E03 | 9.0E−04* | NB* | NB* |
| Class 1 | 03B08 | 1.0E−04* | NB* | NB* |
| Class 1 | 03E05 | 1.0E−04* | NB* | NB* |
| Class 2 | 01D06 | 9.7E−04* | NB* | 1.3E−03* |
| Class 2 | 02A08 | 4.2E−04 | NB* | 1.5E−04 |
| Class 2 | 02A10 | 2.2E−04 | NB* | 2.8E−04 |
| Class 2 | 03C07 | 2.0E−04 | NB* | 7.6E−04 |
| Class 2 | 04A02 | 1.3E−03* | NB* | 1.1E−02* |
| Class 2 | 04B09 | 2.7E−04 | NB* | 3.5E−04 |
| Class 2 | 04B10 | 4.0E−04 | NB* | 5.0E−04 |
| Class 2 | 04F09 | 6.3E−04 | NB* | 8.1E−03 |
| Class 2 | 04G01 | 1.8E−04 | NB* | 2.3E−04 |
| Class 2 | 09D10 | 1.5E−04* | NB* | 1.7E−03* |
| Class 2 | 09G10 | 1.2E−04 | NB* | 1.3E−04 |
| Class 2 | 11A06 | 1.6E−04 | NB* | 3.8E−05 |
| Class 3 | 06E11 | NB* | 3.10E−04 | 4.4E−03 |
| Class 3 | 07B09 | NB* | 1E−03-1E−04 | 1E−03-1E−04 |
| Class 3 | 07B11 | NB* | 1.50E−04 | 4.7E−04 |
| Class 3 | 08A08 | NB* | 4.8E−02 | 7.9E−03 |
| Class 3 | 08B07 | NB* | 1.9E−03 | 2.0E−01 |
| Class 3 | 08H01 | NB* | 8.8E−04 | 1.1E−03 |
| Class 3 | 12A09 | NB* | 1.0E−02-1.0E−03 | 1.7E−02 |
| Class 3 | 16A04 | NB* | 5.30E−04 | 3.0E−03 |
| Class 3 | 24B08 | NB* | <1.0E−05 | <1E−04 |
| Class 3 | 24G10 | NB* | 1.6E−04 | <1E−04 |
| Class 4 | 01A01 | 8.5E−05 | 2.6E−02 | 2.7E−04 |
| Class 4 | 10A04 | <2E−04* | 4.8E−03 | 1.5E−02 |
| Class 4 | 11C08 | 7.9E−03 | 1.3E−02 | 6.3E−03 |
| Class 4 | 13B03 | 6.3E−05 | 5.8E−03 | 3.6E−05 |
| Class 4 | 13B05 | 3.0E−04 | 6.3E−02 | 6.8E−04 |
| Class 4 | 13E02 | 1.3E−04 | 3.6E−03 | 7.1E−05 |
| Class 4 | 13E05 | 1.6E−03 | 1.3E−02 | 1.9E−03 |
| Class 4 | 17C01 | 2.9E−04 | 5.6E−02 | 7.5E−04 |
| Class 4 | 18B05 | 2.2E−04 | 1.4E−01 | 1.2E−04 |

NB = no binding (off-rates marked with * are measured on periplasmic extract, the others are measured on purified protein)

Example 11: Species Cross-Reactivity of Anti-IL-17 Nanobodies

Binding of a selected panel of anti-IL-17 Nanobodies to IL-17 of other species was assessed using a binding ELISA. 96-well Maxisorp plates (Nunc, Wiesbaden, Germany) were coated with IL-17A or IL-17F from different species at 1 μg/ml in PBS. After blocking with PBS/1% casein, anti-IL-17 Nanobodies were added at a concentration of 250 nM in PBS/0.1% casein/0.05% Tween20. HRP (horseradish peroxidase) conjugated anti-myc (Serotec, MCA 2200P) was used for detection using esTMB as substrate. IL-17A from marmoset, mouse or guinea pig origin, and IL-17F from marmoset, mouse and rat origin were expressed under the same conditions as described in Example 1 for human IL-17A and F using Hek293 cells. Rat IL-17A produced in *E. coli* was purchased from eBioscience (San Diego, Calif., USA; Cat Nr 14-8170). Class 2 and Class 4 Nanobodies all cross-reacted with marmoset IL-17A, but not with mouse, rat or guinea pig IL-17A (Table 9). Most Nanobodies from Class 3 and Class 4 cross-reacted with marmoset IL-17F, albeit to a lesser extent. These Nanobodies did not cross-react with mouse or rat IL-17F (Table 10).

TABLE 9

OD-values for binding of the anti-IL-17 Nanobodies to IL-17A from human, marmoset, mouse, rat and guinea pig origin in ELISA

| Nanobody Class | Nanobody | Human IL-17A | Marmoset IL-17A | Mouse IL-17A | Rat IL-17A | Guinea pig IL-17A |
|---|---|---|---|---|---|---|
| Class 2 | 02A08 | 1.945 | 1.953 | −0.001 | 0.002 | 0.002 |
| Class 2 | 03C07 | 1.704 | 1.699 | −0.004 | 0.003 | 0.004 |
| Class 2 | 04B09 | 1.817 | 1.842 | 0.000 | 0.001 | 0.006 |
| Class 2 | 04G01 | 1.897 | 1.932 | −0.001 | 0.004 | 0.008 |
| Class 2 | 09G10 | 1.635 | 1.582 | −0.001 | 0.003 | 0.006 |
| Class 2 | 11A06 | 1.691 | 1.707 | 0.004 | 0.008 | 0.007 |
| Class 3 | 06E11 | 0.073 | −0.003 | −0.001 | 0.006 | 0.006 |
| Class 3 | 07B09 | 0.005 | 0.005 | −0.001 | 0.003 | 0.009 |
| Class 3 | 07B11 | 0.030 | 0.186 | −0.003 | 0.005 | 0.007 |
| Class 3 | 08H01 | 0.022 | 0.431 | −0.002 | 0.006 | 0.007 |
| Class 3 | 16A04 | 0.043 | 0.019 | −0.002 | 0.003 | 0.008 |
| Class 3 | 24B08 | 0.103 | 0.129 | −0.002 | 0.004 | 0.012 |
| Class 3 | 24G10 | 0.009 | 0.122 | −0.001 | 0.004 | 0.008 |
| Class 4 | 01A01 | 1.830 | 1.839 | −0.003 | 0.004 | 0.008 |
| Class 4 | 11C08 | 1.710 | 0.671 | −0.005 | 0.002 | 0.002 |
| Class 4 | 13B03 | 1.948 | 1.936 | −0.001 | 0.004 | 0.004 |
| Class 4 | 13B05 | 1.824 | 1.911 | −0.006 | 0.003 | 0.001 |
| Class 4 | 13E02 | 1.787 | 1.846 | −0.001 | 0.003 | 0.006 |
| Class 4 | 13E05 | 1.957 | 1.889 | 0.004 | 0.003 | 0.006 |
| Class 4 | 17C01 | 1.826 | 1.843 | −0.001 | 0.000 | 0.007 |

TABLE 10

OD-values for binding of the anti-IL-17 Nanobodies to IL-17F from human, marmoset, mouse and rat origin in ELISA

| Nanobody Class | Nanobody | Human IL-17F | Marmoset IL-17F | Mouse IL-17F | Rat IL-17F |
|---|---|---|---|---|---|
| Class 2 | 02A08 | −0.014 | −0.0005 | −0.0005 | 0.0035 |
| Class 2 | 03C07 | −0.016 | −0.0015 | 0.0005 | 0.0015 |
| Class 2 | 04B09 | −0.015 | 0.0025 | −0.0025 | 0.0015 |
| Class 2 | 04G01 | −0.016 | 0.0005 | −0.0005 | −0.0005 |
| Class 2 | 09G10 | −0.018 | 0.0045 | −0.0005 | 0.0025 |
| Class 2 | 11A06 | 0.673 | 0.0225 | 0.0455 | 0.0045 |
| Class 3 | 06E11 | 2.593 | 2.123 | 0.0215 | 0.0085 |
| Class 3 | 07B09 | 1.872 | 1.0855 | −0.0015 | 0.0025 |
| Class 3 | 07B11 | 1.849 | 1.6395 | −0.0005 | −0.0105 |
| Class 3 | 08H01 | 1.767 | 0.5515 | −0.0005 | 0.0045 |
| Class 3 | 16A04 | 1.736 | 1.6365 | −0.0015 | 0.0015 |
| Class 3 | 24B08 | 1.815 | 1.7625 | −0.0015 | 0.0035 |

TABLE 10-continued

OD-values for binding of the anti-IL-17 Nanobodies to IL-17F from human, marmoset, mouse and rat origin in ELISA

| Nanobody Class | Nanobody | Human IL-17F | Marmoset IL-17F | Mouse IL-17F | Rat IL-17F |
|---|---|---|---|---|---|
| Class 3 | 24G10 | 1.96 | 1.6365 | −0.0005 | 0.0025 |
| Class 4 | 01A01 | 0.612 | 0.2195 | −0.0005 | 0.0005 |
| Class 4 | 11C08 | 1.655 | 1.4045 | −0.0025 | 0.0005 |
| Class 4 | 13B03 | 1.656 | 1.3255 | −0.0005 | 0.0085 |
| Class 4 | 13B05 | 0.712 | 0.445 | 0.0205 | 0.0095 |
| Class 4 | 13E02 | 1.099 | 0.248 | 0.0155 | 0.0255 |
| Class 4 | 13E05 | 1.771 | 0.3375 | 0.0005 | 0.0025 |
| Class 4 | 17C01 | 0.772 | 0.0525 | −0.0005 | 0.0025 |

Example 12: Specificity of the Anti-IL-17 Nanobodies

Off-target binding of a selected panel of anti-IL-17 Nanobodies 02A08, 03C07, 04B9, 04G1, 09G10, 11A06 (Class 2), 06E11, 07B09, 07B11, 08H01, 16A04, 24G10 (Class 3), and 01A01, 11C08, 13B03, 13B05, 13E02, 13E05, 17C01 (Class 4) was assessed by measuring the binding capacity of the anti-IL-17 Nanobodies to human IL-17B (Peprotech Cat No. 200-28), IL-17C(R&D Systems, Cat No. 234-IL/CF), IL-17D (Peprotech 200-27) or IL-17E (Peprotech Cat No. 200-24), by SPR using a Biacore 1100 instrument. Human IL-17B, IL-17C, IL-17D or IL-17E were all expressed in *E. coli*, and covalently bound to a CM sensor chip surface via amine coupling using EDC/NHS for activation and HCl for deactivation. Purified Nanobodies or control mAbs (anti-hIL-17B Mab1248, anti-hIL-17E Mab1258, anti-hIL-17C Mab1234, anti-hIL-17D Mab1504, R&D Systems), were injected for 2 minutes at a flow rate of 45 μl/min to allow binding to chip-bound antigen. Next, binding buffer was sent over the chip at the same flow rate to allow spontaneous dissociation of bound Nanobody or antibody. Whereas all control antibodies bound to their respective targets, the tested Nanobodies did not bind to human IL-17B, IL-17C, IL-17D or IL-17E.

Example 13: Epitope Mapping Using Site Directed Mutagenesis

A. Design of Mutant IL17A and IL17F

Human IL-17A an F being symmetrical dimers, the corresponding mutation sets were defined on a single chain of the monomer. The network of mutations was distributed at the surface of the dimer in a symmetrical way. The detailed list of mutations is as follows:

For IL-17A: K38E, K38A, D42A, N45A, N45Q, R46A, H54A, K70A, K70Q, R72A, H73A, L74A, 177A, D80A, N82K, N82A, Y85A, H86A, N88A

For IL-17F: S39E, S39A, N43A, R47A, T55A, T55H, Q71A, Q71K, R73A, N74A, L75A, I78A, Q81A, K83N, K83A, I86A, S87A, S87H, N89A

All the selected positions were mutated to an Alanine, a neutral amino acid, which is usually well tolerated at most positions in a protein structure. Other amino acids than Ala were also used at certain positions in order to introduce a more drastic change. As mentioned earlier, all these position cover half the surface of IL-17A and F.

B. Principle of the Screening Method

Single amino acid mutants of FLAG-tagged IL-17A and F were obtained by site-directed mutagenesis, transiently expressed in HEK-293 cells and tested by ELISA for binding of the Nanobodies. The binding of each Nanobody to single IL-17 mutants was compared and normalized to that of the same Nanobody to the wild type cytokine. A polyclonal specific anti-IL-17 antibody was used as positive control to check for the structural integrity of the mutant molecules.

C. Construction of Single IL-17 Mutants by Site-Directed Mutagenesis

Single amino acid mutations in IL-17A and F cytokine were introduced with mutagenic oligonucleotides using an adapted version of the Quick Change mutagenesis PCR protocol originally described by Stratagene. The main differences from the original protocol are the use of only one primer rather than 2, the sequence of the sense strand is sufficient and the use of the Pwo DNA polymerase from Roche (Cat No. 03789403001) rather than the Pfu Turbo DNA polymerase from Stratagene. Both cytokines have a FLAG tag at their C-terminal and were cloned into the expression vector pTT5 (Durocher Y et al., Nucleic Acids Res. 2002, 30, E9) for expression in mammalian cells. The final constructs were confirmed by DNA sequence analysis of the full length IL-17A or IL-17F coding gene.

D. Transient Expression of Single IL-17 Mutants in Mammalian Cells

Small-scale production of the recombinant Flag-tagged IL-17A and -F mutants as well as reference parental wild type cytokines was performed in a 6-well plate format by growing HEK-293 cells in D-MEM/F-12 (1:1) medium (Invitrogen cat no 21331-020) supplemented with 10% FCS, 2 mM L-Glutamine, 100 U/ml Penicillin and 100 μg/ml Streptomycin. The TransIT-LT1 transfection reagent from Minis Bio Corporation (cat no MIR-2305) was used according to the protocol recommended by the supplier. Transfections were carried out in serum-containing media. Briefly, 2.5 μg of LPS-free miniprep plasmid DNA per well of a 6-well plate were used for transfection and the incubation time was between 48 and 72 hours.

E. ELISA protocol for detection of Nanobody binding to IL-17 mutants

Nunc-Immuno plates Maxisorp (invitrogen, Nunc #439454) were coated overnight at 4° C. with polyclonal rabbit anti-FLAG® epitope (DYKDDDDK) antibody (Covance #PRB-132P) at 2 μg/ml in PBS, pH 7.4. The plates were washed 3 times in PBST (PBS containing 0.05% Tween20) and the undiluted neat tissue culture supernatants containing the IL-17-FLAG-tagged mutants were incubated for 1 hr30 at 37° C. The plates were washed with PBST 3 times and blocked for 2 hrs at 37° C. with PBS containing 2% BSA. The plates were washed 3 times with PBST and the different anti-IL17 HIS and cmyc-tagged monovalent nanobodies added to the wells at 5 μg/ml in PBS pH 7.4. The plates were incubated for 2 hrs at 37° C. and then washed 3 times with PBST. The secondary HRP-conjugated rabbit polyclonal to 6×His Tag® (HHHHHH) antibody (Abcam #ab1187) was then added to the wells at 1/5000 dilution in PBS pH 7.4. The plates were incubated for 45 min at room temperature (RT), washed 3 times with PBST and 100 μl/well of the tetramethylbenzidine (TMB) ELISA peroxidase substrate solution (Uptima #UP664781) added. The plates were left for 5 min at RT, blocked with 1M $H_2SO_4$ and the OD read at 450 nm. In order to verify that the single IL-17 mutants and wild type cytokines were expressed, structurally well folded and well captured by anti-FLAG antibody, a polyclonal anti-IL17A or -F were used as primary antibodies followed by a HRP-conjugated secondary antibody. For IL-17A and IL-17F constructs a polyclonal Goat IgG anti-human IL-17A (Life span, #LS-C37027) and a polyclonal Goat IgG anti-human IL-17F (R&D systems, #AF1335) were used, respectively; followed by a HRP-conjugated bovine anti-goat IgG(H+L) for detection (Jackson ImmunoResearch #805-035-180).

Epitope Recognized by Class 2 Nanobodies

Five residue positions were identified that are common to all A-blockers and X-reactive Nanobody epitopes: L74, Y85, H73, N82 and R72 (Table 11). Both L74 and Y85 are crucial positions for the said epitopes, as, in all expect one case, they strongly affect Nanobody binding. Binding affinity of the selected Nanobodies to those two mutants is always below 50% of the wild type binding at least, and in most cases is below 25%. The exception is Y85 for 4B09 where binding affinity is 60% of that of the wild type protein. In light of our results, L74 can be clearly categorized as a hot spot. To a lower extent, H73 also appeared as a very important residue for all epitopes. A few positions discriminate A-blockers versus X-reactive Nanobodies. N88 was found exclusively in epitopes of X-reactive Nanobodies (except 11C08). By contrast, either H54 or K70 was found in epitopes of A-blockers, but rarely in epitopes of X-reactive Nanobodies. Among the five common residue positions between A-blocker and X-reactive epitopes on IL-17A, three have different amino acids in IL-17F (Y85I, $H_{73}$N and N82K). This suggests that epitopes of X-reactive Nanobodies does not have to be strictly identical between related proteins. A certain degree of variability in the amino acid set which constitutes an epitope is tolerated. However, the two key residues (L74, Y85) have identical counterparts in IL-17F (L75, I86).

Epitope Recognized by Class 4 Nanobodies

Only the X-reactive Nanobodies 13B03 and 13E02 were tested as Fc fusions against the IL-17 mutants. Their affinity is on average 10 times less on IL-17F than on IL-17A. As for IL-17A, L75 and I86 (the equivalent residues of L74 and Y85 in IL-17A) are crucial positions in the epitopes of all Nanobodies on IL-17F. Moreover, our results indicate that I78 is also a key residue in all Nanobody epitopes on IL-17F. The later result is difficult to explain as we did not observe a similar behavior of the equivalent position (177) in IL-17A, even for the X-reactive Nanobodies. The distinction between the average A-blocker and X-reactive epitopes observed on IL-17A was not possible on IL-17F as the corresponding experimental data set was limited (only two cross-reactive Nanobodies tested due to weak binding of monovalent forms).

All the mutants were tested for binding to both chains of the receptor complex, IL-17RA and IL-17RC. Results obtained on IL-17A indicate that R46 is strongly involved in the binding site of both receptor chains (data not shown). This data, in combination with the X-ray structure of the complex between IL-17F and IL-17RA (Ely et al., Nature Immunology 10, 1245-1251, 2009), provides some clues that the epitopes of most Nanobodies tested are likely to overlap partially with the receptor binding site on IL-17A.

From below Table 11 it becomes clear that Y85 is an important residue since it affects all 3 Nanobodies binding to IL-17A tested. N88 is critical for cross-(X)-reactive Nanobodies and not the others.

Epitope Recognized by Class 3 Nanobodies

For the anti-IL-17F specific Nanobody 4 positions on IL-17F have been identified as critical R73, I86 and N89, interestingly they correspond to the positions L74, Y85 and N88 on IL-17A which have been also shown as critical for the Nanobodies. R47 looks critical which was not seen for IL-17A (R46).

TABLE 11

Percentage binding of nanobodies to IL-17A single alanine mutants as normalised to the binding of a polyclonal anti-IL-17A

| Human IL-17A mutant | R46 | L74 | H54 | N78 | D80 | Y85 | N88 |
|---|---|---|---|---|---|---|---|
| class 2 | 90 | 13.6 | 18 | 100 | 100 | 12 | 93 |
| class 4 | 92 | 9.6 | 81 | 100 | 95 | 29 | 9 |
| class 4 | 89 | 9.2 | 100 | 100 | 100 | 11 | 38 |

| Human IL-17F mutant | R47 | R73 | I86 | N89 |
|---|---|---|---|---|
| class 3 | 14.2 | 18.3 | 2.8 | 1.7 |

Example 14: Epitope Binning of the Monovalent Nanobodies Versus the IL-17 Receptors To investigate whether the selected anti-IL-17 Nanobodies bind to an overlapping epitope on IL17A, respectively IL-17F as IL-17RA respectively IL-17RC, an epitope binning experiment on Biacore was set up. The receptor (IL-17RA or IL-17RC) was captured via its human Fc-tail by an anti-human IgG-Fc antibody coated on the chip. Subsequently, a mixture of IL-17A or IL-17F complexed to a Nanobody was injected over the surface. Concentrations of IL-17A or IL-17F were used for which theoretical calculations showed complex formation for >99% of the IL-17. For none of the Class 2 or Class 4 Nanobody-IL-17A complexes, binding to IL-17RA was observed (Table 12), indicating that these Nanobodies bind to a similar epitope on IL-17A as IL-17RA. For the Class 3 Nanobodies only one Nanobody-IL-17F complex, 24B08-IL-17F, showed binding to IL17RC (Table 12), indicating that this Nanobody interacts with a different epitope on IL-17F as IL-17RC. For the Class 4 Nanobodies, only 2 Nanobody-IL-17F complexes did not bind to IL-17RC; 11C08, and 13E02. 01A01, 13B03 and 13E05-IL-17F complexes showed minor binding, whereas 13B05 and 17C01 showed significant binding, indicating that the IL-17F epitope recognized by these Nanobodies is only partly overlapping with IL-17RC.

TABLE 12

% Biacore binding of the IL-17—Nanobody complex to immobilized IL-17RC or IL-17RA

| Nanobody | Nanobody Class | % Biacore binding (IL-17A-NB)-IL-17RA | % Biacore binding (IL-17F-NB)-IL-17RC |
|---|---|---|---|
| 02A08 | Class 2 | 0.46 | |
| 03C07 | Class 2 | −0.08 | |
| 04B09 | Class 2 | −1.39 | |
| 04G01 | Class 2 | −0.43 | |
| 09G10 | Class 2 | 2.05 | |
| 11A06 | Class 2 | −0.35 | |
| 06E11 | Class 3 | | 8.17 |
| 07B09 | Class 3 | | 5.17 |
| 07B11 | Class 3 | | 6.67 |
| 08H01 | Class 3 | | 9.17 |
| 16A04 | Class 3 | | 4.84 |
| 24B08 | Class 3 | | 59.88 |
| 24G10 | Class 3 | | 8.51 |
| 01A01 | Class 4 | −1.04 | 12.01 |
| 11C08 | Class 4 | 3.25 | 6.34 |
| 13B03 | Class 4 | −2.24 | 15.68 |

TABLE 12-continued

% Biacore binding of the IL-17—Nanobody complex to immobilized IL-17RC or IL-17RA

| Nanobody | Nanobody Class | % Biacore binding (IL-17A-NB)-IL-17RA | % Biacore binding (IL-17F-NB)-IL-17RC |
|---|---|---|---|
| 13B05 | Class 4 | −0.89 | 35.03 |
| 13E02 | Class 4 | −1.04 | 7.17 |
| 13E05 | Class 4 | 0.54 | 15.51 |
| 17C01 | Class 4 | −2.01 | 32.53 |

To confirm the fact that most Class 2 and Class 4 Nanobodies recognize an overlapping epitope on IL-17A, a SPR experiment was conducted whereby human IL17A was immobilized on the sensor chip, the Class 4 Nanobody 01A01 was bound and subsequently a second test Nanobody from Class 2 or Class 4 was send over the chip. If no increase in RU levels was observed, the test Nanobody binds to an overlapping epitope than 01A01. This was the case for all tested Nanobodies, except for 11A06, again confirming that this Nanobody binds to a different epitope on IL-17A. The results are shown in FIG. 10.

Similarly, by immobilizing human IL-17F, binding of the Class 3 Nanobody 07B11, and subsequential binding of a second test Nanobody from Class 3 or Class 4, it was shown that all those Nanobodies recognize an overlapping epitope, except for 24B08, which again confirms the observations described above. The results are shown in FIG. 11.

Example 15: Generation of Multivalent Wild-Type Anti-IL-17 Nanobodies with Half-Life Extension (HLE)

In order to generate a half-life extended Nanobody product that blocks IL-17A, IL-17F and IL-17A/F, the monovalent Nanobodies were formatted. Class 2 (IL-17A and IL-17A/F-blocking, further indicated in figures with A) and Class 3 Nanobodies (IL-17F-blocking, further indicated with F) were combined into A-F or F-A combinations. The Class 4 (IL-17A-IL-17F cross-reactive Nanobodies, further indicated with X, were formatted into a bivalent construct X-X or combined with a Class 3 Nanobody F-X or X-F. For half-life extension it was opted to fuse the constructs either to the anti-HSA Nanobody ALB8 or to an Fc-portion.

Formatted Wild-Type Nanobodies with ALB8 HLE

It was opted to make on the DNA-level various A-F, F-A, X-X, F-X and X-F combinations, and to also vary the position of the ALB8 Nanobody, either between the anti-IL-17 Nanobodies linked at both sites via 9GS-linkers or at the C-terminus of the construct, wherein the two anti-IL-17 Nanobodies are linked via a 35GS-linker and ALB8 is linked to the middle Nanobody via a 9GS-linker. The monovalent Nanobodies used as building blocks are shown in Table 13.

TABLE 13

Nanobodies selected as building blocks for the formatted constructs. Only the cross-reactive Nanobodies indicated in bold were used in the F-X and F-X combinations.

| Class 2 (A) | Class 3 (F) | Class 4 (X) |
|---|---|---|
| 02A08 | 06E11 | **01A01** |
| 03C07 | 07B11 | 11C08 |
| 04B09 | 08H01 | **13B03** |
| 04G01 | 16A04 | 13B05 |

TABLE 13-continued

Nanobodies selected as building blocks for the formatted constructs. Only the cross-reactive Nanobodies indicated in bold were used in the F-X and F-X combinations.

| Class 2 (A) | Class 3 (F) | Class 4 (X) |
|---|---|---|
| 09G10 | 24G10 | **13E02** |
| 11A06 | | 13E05 |

A selection of 50 multivalent Nanobodies was expressed as c-myc, His6-tagged protein in *Pichia pastoris* (amino acid sequences are shown in FIG. 6). Induction of Nanobody expression occurred by stepwise addition of methanol. Clarified medium with secreted Nanobody was used as starting material for immobilized metal affinity chromatography (IMAC) followed by desalting resulting in 90% purity as assessed by SDS-PAGE. Where appropriate, the methods described in WO 2010/125187 were applied to further improve expression and folding.

Formatted Wild-Type Nanobodies with Fc HLE

Bivalent cross-reactive Nanobodies fused to an Fc-tail were constructed. Fc-fusions were made of the cross-reactive Nanobodies 01A01, 13E02 and 13B03. Constructs were made with a short hinge region from human IgG1 C→S (sequence: EPKSSDKTHTCPPCP) or with a long hinge region from llama IgG2b (EPKTPKPQPQPQPQPNPT-TESKCPKCP). Also two types of signal peptides were used: the one from VH3-23 (hIgG HC), with the sequence MEF-GLSWLFLVAKIKGVQC and the one from the mouse germline, with sequence MEWSWVFLFFLSVTTGVHS, for secretion of these Nanobodies after expression in Hek-293-6E cells. Fc-constructs were transiently transfected in Hek-293-6E cells, and expressed Nanobodies got secreted into the culture medium (75-400 ml Freestyle medium). The medium was harvested 3 days post-transfection and the Fc-fused Nanobodies were purified using Protein A chromatography (Mab Select Sure), followed by size exclusion chromatography.

Example 16: Blocking Capacity of Purified Multivalent Wild-Type Anti-IL-17 Nanobodies with ALB8 HLE in AlphaScreen Assays Using Human IL-17A, IL-17F and IL-17A/F The 50 multivalent Nanobodies were tested in the AlphaScreen IL-17A-IL-17RA, IL-17F-IL-17RC and IL-17-A/F-RA assay, as described in Example 8, but with optimised ligand and receptor concentrations as shown in Table 14, and using a dilution series of each Nanobody starting from 50 nM down to 0.181 pM.

TABLE 14

Overview of the optimised concentrations of IL-17 ligand and IL-17 receptors used in the AlphaScreen assays to determine IC50 values of the multivalent Nanobodies

| Assay set-up Ligand-receptor combination | Concentration ligand (nM) | Concentration receptor (nM) |
|---|---|---|
| IL-17A-IL-17RA | 0.10 | 10 |
| IL-17F-IL-17RC | 0.05 | 3 |
| IL-17A/F-IL-17RA | 0.32 | 4 |

Based on potency and maximum level of inhibition, the 14 best multivalent Nanobodies were chosen for further characterization. For nine of them IC50's in all six Alphascreen assays were measured. In addition, it was investigated whether presence of HSA in the Alphascreen assay influences the IC50. To this end, the IL-17A-IL-17RA, IL-17F-IL-17RC and the IL-17A/F-IL-17RA assays were repeated in absence or presence of 5 μM HSA. For the other five Nanobodies only potencies in IL-17A-IL-17RA and IL-17F-IL-17RC assay were measured. Results are summarized in Table 15. All Nanobodies show very good potencies, albeit that the X-X formats are less potent in blocking the IL-17F-receptor interactions. The presence of HSA did not have a major influence on the potencies.

TABLE 16

IC50 values for the multivalent anti-IL17 Nanobodies determined in a competition ELISA

| Test compound | IC50 Competition ELISA IL17A-RA (pM) | IC50 Competition ELISA IL17F-RC (pM) |
|---|---|---|
| 13B03-9GS-ALB8-9GS-13B03 | 20 | 148 |
| 13B03-SH-Fc | 20 | 3364 |
| 13B03-LH-Fc | 31 | 292 |
| SH-Fc-(GS)2-13B03 | 44 | 350 |
| 13E02-35GS-13E02-9GS- | 102 | 534 |

TABLE 15

Summary of IC50-values for the selected panel of 14 formatted wild-type anti-IL17 Nanobodies derived from Alphascreen, nd =not determined

| | | | IC50 (pM) AlphaScreen | | | | | | | | |
|---|---|---|---|---|---|---|---|---|---|---|---|
| Specificity | Nanobody ID | Construct | IL17A-RA | IL17A-RA + HSA | IL17A-RC | IL17F-RA | IL17F-RC | IL17F-RC + HSA | IL17A/F-RA | IL17A/F-RA + HSA | IL17A/F-RC |
| A-F | IL17MS0089 | 02A08-35GS-16A04-9GS-ALB8 | 115 | 185 | 130 | 369 | 41 | 54 | 97 | 131 | 47 |
| F-A | IL17MS0141 | 07B11-35GS-04B09-9GS-ALB8 | 87 | 92 | 146 | 819 | 29 | 36 | 99 | 130 | 68 |
| F-A | IL17MS0166 | 24G10-35GS-04G01-9GS-ALB8 | 161 | 203 | 367 | 1094 | 46 | 56 | 128 | 95 | 51 |
| X-X | IL17MS1003 | 13B03-9GS-ALB8-9GS-13B03 | 116 | 72 | 171 | 564 | 189 | 177 | 85 | 90 | 45 |
| X-X | IL17MS1013 | 13E02-35GS-13E02-9GS-ALB8 | 64 | 67 | 167 | 408 | 102 | 113 | 101 | 86 | 104 |
| F-X | IL17MS2022 | 16A04-9GS-ALB8-9GS-13B03 | 63 | 83 | 183 | 456 | 23 | 28 | 98 | 90 | 39 |
| F-X | IL17MS2024 | 16A04-9GS-ALB8-9GS-13E02 | 99 | 70 | 170 | 328 | 17 | 22 | 142 | 124 | 50 |
| X-F | IL17MS2042 | 01A01-9GS-ALB8-9GS-24G10 | 130 | 111 | 152 | 619 | 30 | 35 | 122 | 99 | 59 |
| F-X | IL17MS2081 | 07B11-35GS-01A01-9GS-ALB8 | 78 | 86 | 138 | 543 | 22 | 27 | 99 | 100 | 36 |
| A-F | IL17MS0110 | 04G01-35GS-16A04-9GS-ALB8 | 45 | nd | nd | nd | 48 | nd | nd | nd | nd |
| F-A | IL17MS0154 | 16A04-35GS-04001-9GS-ALB8 | 56 | nd | nd | nd | 47 | nd | nd | nd | nd |
| X-X | IL17MS1005 | 13E02-9GS-ALB8-9GS-13E02 | 56 | nd | nd | nd | 363 | nd | nd | nd | nd |
| X-F | IL17MS21 | 13B03-35GS-16A04-9GS-ALB8 | nd | nd | nd | nd | 30 | nd | nd | nd | nd |
| X-F | IL17MS2131 | 13E02-35GS-16A04-9GS-ALB8 | 44 | nd | nd | nd | 20 | nd | nd | nd | nd |

Example 17: Blocking Capacity of Purified Multivalent Cross-Reactive Anti-IL-17 Nanobodies with ALB8 HLE Versus Fc HLE in Competition ELISA Using Human IL-17A or IL-17F The potency of the formatted Nanobodies carrying ALB8 HLE, 13E02-35GS-13E02-9GS-ALB8 and 13B03-9GS-ALB8-9GS-13B03 was compared with the potency of the same Nanobodies carrying the Fc-HLE, SH-Fc-(GS)$_{2\text{-}13}$E02 and 13B03-5H-Fc 13B03-LH-Fc in a competition ELISA. To this end, IL-17RA, respectively IL-17RC was coated at a concentration of 1 μg/ml in PBS. A dilution series of the Nanobodies or reference compounds was incubated with biotinylated IL-17A (12 pM), respectively IL-17F (10 pM) and binding to the receptor was detected with extravidin-HRP. In both assays, all formatted Nanobodies show improved potency compared to their monovalent counterpart and most Nanobodies have better potencies than the reference compounds, as shown in Table 16.

TABLE 16-continued

IC50 values for the multivalent anti-IL17 Nanobodies determined in a competition ELISA

| Test compound | IC50 Competition ELISA IL17A-RA (pM) | IC50 Competition ELISA IL17F-RC (pM) |
|---|---|---|
| ALB8 | | |
| SH-Fc-(GS)2-13E02 | 112 | 267 |
| 13B03 | 121 | 91600 |
| 13E02 | 420 | 3020 |
| mAB02 | 914 | |
| B-F60 mAB | | 1200 |

Example 18: Blocking Activity of Purified Formatted Wild-Type Anti-IL-17 Nanobodies in Cell-Based Assay Using Human IL-17A, IL-17F and IL-17A/F in Presence or Absence of HSA For 9 selected formatted Nanobodies with ALB-HLE, and 4 Fc-fused Nanobodies, the dose-dependent inhibition of hIL-17A, hIL-17F or hIL-17A/F induced IL-6 secretion by HT-1080 cells was investigated. Human HT-1080 fibrosarcoma cells were seeded at 1500 cells/well in 96-well flat bottom plates. Serial 1:3 dilutions of Nanobodies, mAB02 reference compound or anti-IL-17F B-F60 mAb reference compound were made and added to the wells with the HT-1080 cells, resulting in final concentrations ranging from 10 μg/mL to 0.0045 μg/mL for the Nanobodies and mAB02 and from 100 μg/mL to 0.045 μg/mL for mAB B-F60. In the first experiments, Nanobodies were added as such (Table 17), in a second experiment, Nanobodies were preincubated with 100 μM HSA (Table 18). Plates were incubated for 30 min. at 37° C. with 5% $CO_2$ before adding specific stimuli, which were either human IL-17A at 1 nM final concentration, human IL-17F at 15 nM final concentration or human IL-17A/F at 5 nM final concentration. Plates were incubated for another 24 hours at 37° C. with 5% CO2. Supernatants were harvested, transferred into 96-well plates, and levels of human IL-6 were determined using a commercial IL-6 ELISA assay. As shown in Table 17, all Nanobodies had similar potencies (IC50 in the range of 0.19-0.78 nM) for blocking IL-17A activity, irrespective of the format or FILE. The potency for blocking IL-17F activity was also similar for all Nanobodies (IC50 in the range of 2.7-8.2 nM). As shown in Table 18 (compared to Table 17), the presence of 100 μM HSA in the assay did not have influence on the potency of the Nanobodies.

TABLE 17

Inhibition of human IL-17A or IL-17F induced IL-6 production in human fibrosarcoma HT-1080 cells by formatted wild-type anti-IL-17 Nanobodies or reference compounds without HSA.

| specificity | Nanobody or reference | Construct | IC50 (nM) hIL-17A | Emax (%) | IC50 (nM) hIL-17F | Emax (%) |
|---|---|---|---|---|---|---|
| A-F | IL17MS0089 | 02A08-35GS-16A04-9GS-ALB8 | 0.38 ± 0.1 | 102 ± 1 | 4 | 87 |
| F-A | IL17MS0141 | 07B11-35GS-04B09-9GS-ALB8 | 0.25 | 105 | 5.9 | 110 |
| F-A | IL17MS0166 | 24G10-35GS-04G01-9GS-ALB8 | 0.83 | 105 | 7.35 ± 2 | 102 ± 3 |
| X-X | IL17MS1003 | 13B03-9GS-ALB8-9GS-13B03 | 0.45 ± 0.03 | 101 ± 1 | 6.4 ± 5 | 101 ± 4 |
| X-X | IL17MS1013 | 13E02-35GS-13E02-9GS-ALB8 | 0.47 ± 0.04 | 102 ± 3 | 6.45 ± 2 | 97.5 ± 1 |
| F-X | IL17MS2022 | 16A04-9GS-ALB8-9GS-13B03 | 0.60 ± 0.1 | 102± | 8.05 ± 0.2 | 97 ± 5 |
| F-X | IL17MS2024 | 16A04-9GS-ALB8-9GS-13E02 | 0.78 ± 0.1 | 103 ± 4 | 8.2 ± 0.6 | 96 ± 7 |
| X-F | IL17MS2042 | 01A01-9GS-ALB8-9GS-24G10 | 0.28 | 101 | 6.6 | 111 |
| F-X | IL17MS2081 | 07B11-35GS-01A01-9GS-ALB8 | 0.7 | 100 | 6.3 | 99 |
| X-X | MSB0010606 | 13E02-LH-Fc | 0.19 ± 0.1 | 100 ± 6 | 2.7 ± 2.9 | 96 ± 4 |
| X-X | MSB0010619 | SH-Fc-(GS)2-13E02 | 0.31 ± 0.3 | 102 ± 5 | 4.9 ± 3.5 | 98 ± 6 |
| X-X | MSB0010618 | SH-Fc-(GS)2-13B03 | 0.37 ± 0.3 | 100 ± 6 | 5.7 ± 3.2 | 94 ± 14 |
| X-X | MSB0010493 | 13B03-SH-Fc | 0.19 ± 0 | 100 ± 4 | 5.8 ± 0.3 | 105 ± 15 |
| A | mAb02 | | 0.59 ± 0.4 | 99 ± 2 | ND | ND |
| F | B-F60 mAb | | ND | ND | 3.9 ± 3.12 | 93 ± 10 |

Results are expressed as mean ± SD of N (1 to 7) experiments.

TABLE 18

Inhibition of human IL-17A, IL-17F or IL-17A/F induced IL-6 production in human fibrosarcoma HT-1080 cells by formatted wild-type anti-IL-17 Nanobodies or reference compounds in the presence of 100 μM HSA.

| property | Nanobody or reference | Construct | IC50 (nM) hIL-17A | Emax (%) | IC50 (nM) hIL-17F | Emax (%) | IC50 (nM) hIL-17A/F | Emax (%) |
|---|---|---|---|---|---|---|---|---|
| A-F | IL17MS0089 | 02A08-35GS-16A04-9GS-ALB8 | 1.00 ± 0.6 | 97 ± 1 | 7.3 ± 1.3 | 89.5 ± 1 | 1.01 ± 0.1 | 83 ± 3 |
| F-A | IL17MS01411 | 07B11-35GS-04B09-9GS-ALB8 | 0.85 ± 0.5 | 98 ± 0 | 14.8 ± 10.2 | 91.5 ± 5 | 0.34 ± 0.1 | 78 ± 3 |
| F-A | IL17MS0166 | 24G10-35GS-04G01-9GS-ALB8 | 1.95 ± 0.6 | 98 ± 1 | 8.5 ± 3.5 | 85.0 ± 8 | 1.47 ± 0.5 | 72 ± 15 |
| X-X | IL17MS1003 | 13B03-9GS-ALB8-9GS-13B03 | 1.55 ± 1.2 | 96 ± 1 | 10.8 ± 3.2 | 86.5 ± 6 | 0.53 ± 0.4 | 78 ± 8 |

TABLE 18-continued

Inhibition of human IL-17A, IL-17F or IL-17A/F induced IL-6 production in human fibrosarcoma HT-1080 cells by formatted wild-type anti-IL-17 Nanobodies or reference compounds in the presence of 100 μM HSA.

| property | Nanobody or reference | Construct | IC50 (nM) hIL-17A | Emax (%) | IC50 (nM) hIL-17F | Emax (%) | IC50 (nM) hIL-17A/F | Emax (%) |
|---|---|---|---|---|---|---|---|---|
| X-X | IL17MS1013 | 13E02-35GS-13E02-9GS-ALB8 | 1.00 ± 0.6 | 97 ± 0 | 14.8 ± 3.6 | 81 ± 3 | 0.43 ± 0.1 | 78 ± 6 |
| F-X | IL17MS2022 | 16A04-9GS-ALB8-9GS-13B03 | 0.85 ± 0.4 | 97 ± 0 | 4.1 ± 3.1 | 91.5 ± 1 | 0.61 ± 0.4 | 72 ± 9 |
| F-X | IL17MS2024 | 16A04-9GS-ALB8-9GS-13E02 | 0.90 ± 0.7 | 96 ± 6 | 8.3 ± 0.5 | 91.5 ± 8 | 0.44 ± 0.0 | 86 ± 2 |
| X-F | IL17MS2042 | 01A01-9GS-ALB8-9GS-24G10 | *0.44 | *100 | *5.7 | *93 | 0.57 ± 0.1 | 85 ± 4 |
| F-X | IL17MS2081 | 07B11-35GS-01A01-9GS-ALB8 | 1.05 ± 0.4 | 95 ± 6 | 5.2 ± 4.6 | 93.5 ± 8 | 0.72 ± 0.5 | 87 ± 8 |
| X-X | MSB0010530 | 13B03-LH-Fc | 0.95 ± 0.8 | 97.5 ± 1 | 15.6 ± 0.07 | 75 ± 4 | ND | ND |
| X-X | MSB0010606 | 13E02-LH-Fc | 0.85 ± 0.5 | 98.5 ± 2 | 15.3 ± 1.3 | 80.5 ± 2 | ND | ND |
| A | mAb02 | | 0.65 ± 0.2 | 96 ± 3 | ND | ND | 3.94 ± 5.4 | 74 ± 9 |
| F | mAb B-F60 | | ND | ND | 5.8 ± 2.6 | 84 ± 7 | ND | ND |

Results are expressed as mean ± SD of N experiments.
N = 2 or *N = 1

Example 19: Dual Inhibition of Purified Formatted Wild-Type Anti-IL-17 Nanobodies in HT-1080 Cells Stimulated by Combinations of Human IL-17A and IL-17F As a next step, it was investigated whether the formatted Nanobodies were able to inhibit IL-6 secretion in a dose dependent manner, when HT-1080 cells were stimulated with a combination of human IL-17A and IL-17F. IL-17A and IL-17F were combined at different concentrations: 1) 1 nM IL-17A+15 nM IL-17F, 2) 5 nM IL-17A and 5 nM IL-17F, 3) 15 nM IL-17A and 15 nM IL-17F. The tested set of Nanobodies showed a very good dual inhibitory activity (Table 19).

TABLE 19

IC50-values of some of the formatted WT anti-IL-17 Nanobodies in the HT-1080 bioassay using combinations of human IL-17A and human IL-17F.

| specificity | Nanobody or reference | Construct | IC50 (nM) hIL-17A (1 nM) | IC50 (nM) hIL-17F (15 nM) | IC50 (nM) IL-17A + IL-17F (1 + 15 nM) | IC50 (nM) IL-17A + IL-17F (5 + 5 nM) | IC50 (nM) IL-17A + IL-17F (15 + 15 nM) |
|---|---|---|---|---|---|---|---|
| A-F | IL17MS0089 | 02A08-35GS-16A04-9GS-ALB8 | 0.38 ± 0.1 | *4 | *1.03 | *3.11 | *10.3 |
| X-X | IL17MS1013 | 13E02-35GS-13E02-9GS-ALB8 | 0.47 ± 0.04 | 6.45 ± 2 | *0.82 | *1.64 | *4.9 |
| F-X | IL17MS2022 | 16A04-9GS-ALB8-9GS-13B03 | 0.60 ± 0.1 | 8.05 ± 0.2 | *3.23 | *2.77 | *10.5 |
| F-X | IL17MS2024 | 16A04-9GS-ALB8-9GS-13E02 | 0.78 ± 0.1 | 8.2 ± 0.6 | *3.76 | *3.02 | *11.2 |
| A | mAb02 | | 0.48 ± 0.2 | ND | ND | ND | ND |
| A + F | mAb02 + mAb B-F60 | | ND | ND | *1.03 | *1.23 | *5.3 |
| F | mAb B-F60 | | ND | 2.5 ± 1.6 | ND | ND | ND |

Results are expressed as mean ± SD of N experiments.
N = 2 or * N = 1.
ND: Not Done.

TABLE 20

IC50-values of formatted anti-IL-17 Nanobodies in the HT-1080 bioassay using Cynomolgus monkey IL-17A or IL-17F.

| specificity | Nanobody ID | Construct | IC50 (nM) Cyno IL17A | Emax (%) | IC50 (nM) Cyno IL17F | Emax (%) |
|---|---|---|---|---|---|---|
| A-F | IL17MS0089 | 02A08-35GS-16A04-9GS-ALB8 | 0.52 | 100 | ND | ND |
| X-X | IL17MS1003 | 13B03-9GS-ALB8-9GS-13B03 | 0.86 | 102 | 3.8 ± 4.3 | 98 ± 16 |
| X-X | IL17MS1013 | 13E02-35GS-13E02-9GS-ALB8 | 0.88 | 102 | NI | NI |

TABLE 20-continued

IC50-values of formatted anti-IL-17 Nanobodies in the HT-1080 bioassay using Cynomolgus monkey IL-17A or IL-17F.

| specificity | Nanobody ID | Construct | IC50 (nM) Cyno IL17A | Emax (%) | IC50 (nM) Cyno IL17F | Emax (%) |
|---|---|---|---|---|---|---|
| F-X | IL17MS2022 | 16A04-9GS-ALB8-9GS-13B03 | 0.76 | 101 | 3.6 ± 0.4 | 93 ± 21 |
| F-X | IL 7MS2024 | 16A04-9GS-ALB8-9GS-13E02 | 1.02 | 100 | 4.5 ± 4.9 | 94 ± 20 |
| X-X | MSB0010606 | 13E02-LH-Fc | 0.19 ± 0.09 | 101 ± 7 | NI | NI |
| X-X | MSB0010619 | SH-Fc-(GS)2-13E02 | 0.29 ± 0.09 | 100 ± 6 | 8.3 ± 6 | 87 ± 21 |
| X-X | MSB0010618 | SH-Fc-(GS)2-13B03 | 0.37 ± 0.21 | 98 ± 4 | 5.0 ± 4 | 103 ± 16 |
| X-X | MSB0010493 | 13B03VHH-SH-Fc | 0.21 | 106 | 3.8 | 111 |

Results are expressed as mean ± SD of N (1 to 5) experiments.
NI = non inhibiting

Example 20: Blocking Activity of Purified Formatted Wild-Type Anti-IL-17 Nanobodies in Cell-Based Assays Using Cynomolgus Monkey IL-17A and IL-17F The dose-dependent inhibition of Cynomolgus monkey IL-17A (1 nM) and IL-17F (15 nM) induced IL-6 secretion by the HT-1080 cells was investigated. As the monovalent Nanobodies all showed equal potency towards human and Cynomolgus monkey IL-17A and IL-17F, it was expected that multivalent and Fc Nanobodies would also be equally potent. This was indeed the case for the tested Nanobodies (Table 20), except for IL17MS1013 (13E02-35GS-13E02-9GS-ALB8) and MSB0010606 (13E02-LH-Fc) which showed no inhibition of Cynomolgus IL-17F.

Example 21: Binding of Formatted Wild-Type Anti-IL-17 Nanobodies, Carrying the ALB8 HLE, to Human Serum Albumin For the fourteen formatted wild-type anti-IL-17 Nanobodies carrying the ALB8 HLE, off rates for binding to human serum albumin were determined by surface plasmon resonance, using the Biacore (Table 21). All Nanobodies show similar off-rates ranging from 5.4E-03 to 6.6E-03 s−1. This is slightly higher than the off-rate for ALB8 alone (1.65E-03 s−1), which is generally observed when ALB8 is fused to other Nanobody building blocks, thus, these off-rates are acceptable.

TABLE 21

Affinities for HSA of ALB8 HLE anti-IL-17 Nanobodies compared to the affintiy of ALB8 alone

| specificity | Nanobody ID | Construct | $K_{off}$ (s−1) |
|---|---|---|---|
| A-F | IL17MS0089 | 02A08-35GS-16A04-9GS-ALB8 | 6.60E−03 |
| A-F | IL17MS0110 | 04G01-35GS-16A04-9GS-ALB8 | 6.10E−03 |
| F-A | IL17MS0141 | 07B11-35GS-04B09-9GS-ALB8 | 5.80E−03 |
| F-A | IL17MS0154 | 16A04-35GS-04G01-9GS-ALB8 | 5.70E−03 |
| F-A | IL17MS0166 | 24G10-35GS-04G01-9GS-ALB8 | 5.90E−03 |
| X-X | IL17MS1003 | 13B03-9GS-ALB8-9GS-13B03 | 5.80E−03 |

TABLE 21-continued

Affinities for HSA of ALB8 HLE anti-IL-17 Nanobodies compared to the affintiy of ALB8 alone

| specificity | Nanobody ID | Construct | $K_{off}$ (s−1) |
|---|---|---|---|
| X-X | IL17MS1005 | 13E02-9GS-ALB8-9GS-13E02 | 5.80E−03 |
| X-X | IL17MS1013 | 13E02-35GS-13E02-9GS-ALB8 | 6.40E−03 |
| F-X | IL17MS2022 | 16A04-9GS-ALB8-9GS-13B03 | 5.40E−03 |
| F-X | IL17MS2024 | 16A04-9GS-ALB8-9GS-13E02 | 5.70E−03 |
| X-F | IL17MS2042 | 01A01-9GS-ALB8-9GS-24G10 | 6.30E−03 |
| F-X | IL17MS2081 | 07B11-35G5-01A01-9GS-ALB8 | 6.60E−03 |
| X-F | IL17MS2117 | 13B03-35GS-16A04-9GS-ALB8 | 6.00E−03 |
| X-F | IL17MS2131 | 13E02-35GS-16A04-9GS-ALB8 | 6.20E−03 |

Example 22: Affinity Determination of the Formatted Wild-Type Anti-IL17 Nanobodies Using the KinExA Technology The affinity of a limited set of formatted Nanobodies was determined using the KinExA. As shown in Table 22, there is a definite avidity effect that can been measured when formatting the Nanobodies, this effect is particularly evident on IL-17F for example for the cross-reactive Nanobody 13E02 X-X formatted as 13E02-35GS-13E02-9GS-ALB8 or as an Fc-fusion, for the cross-reactive Nanobody 13B03 X-X formatted as an Fc-fusion and for both Nanobodies F-X formatted as 16A04-9GS-ALB8-9GS-13B03 and 16A04-9GS-ALB8-9GS-13E02. As expected, no avidity effect is observed for A-F constructs, but avidity is not necessary since the building blocks have already a high affinity. For the Fc-fusion constructs, the 13B03-Fc with the long hinge seems to give a higher avidity effect than 13B03-Fc with the short hinge.

TABLE 22

Affinities for human IL-17A and IL17-F binding of some of the monovalent and formatted wild-type anti-IL-17 Nanobodies and reference compounds as determined in KinExA.

| Specificity | Nanobody ID | construct | conc Nanobody (pM) | Kd (pM) IL-17A-6HIS | Kd (pM) IL-17F-6HIS |
|---|---|---|---|---|---|
| A | | 04G01 | 600 | 13.4 | |
| A | | 04B09 | 600 | 20.7 | |
| X | | 01A01 | 200 | 1.3 | |
| X | | 13B03 | 500 | 22.5 | 4910.0 |
| X | | 13E02 | 500 | 35.9 | 3625.0 |
| F | | 16A04 | 100 | | 19.4 |
| F | | 07B11 | 600 | | 12.8 |
| X-X | | 13B03-SH-Fc | 300 | 0.2 | 132.3 |
| X-X | | 13B03-LH-Fc | 50 | 2.0 | 20.0 |
| X-X | | 13B03-LH-Fc | 10 | 0.5 | 22.3 |
| X-X | | SH-(GS)2-Fc-13B03 | 100 | | 144.8 |
| X-X | | SH-(GS)2-Fc-13B03 | 10 | 0.1 | |
| X-X | | 13E02-SH-Fc | 100 | 9.0 | 155.5 |
| X-X | | 13E02-SH-Fc | 30 | 3.6 | |
| X-X | | 13E02-LH-Fc | 600 | | 2040.0 |
| X-X | | SH-(GS)2-Fc-13E02 | 100 | | 11.8 |
| X-X | IL17MS1013 | 13E02-35GS-13E02-9GS-ALB8 | 300 | 0.3 | 230.0 |
| A-F | IL17MS0089 | 02A08-35GS-16A04-9GS-ALB8 | 50 | 7.0 | |
| A-F | IL17MS0089 | 02A08-35GS-16A04-9GS-ALB9 | 100 | | 17.9 |
| A-F | IL17MS0089 | 02A08-35GS-16A04-9GS-ALB9 | 300 | | 156.4 |
| F-A | IL17MS0141 | 07B11-35GS-04B09-9GS-ALB8 | 50 | 5.0 | |
| F-A | IL17MS0141 | 07B11-35GS-04B09-9GS-ALB8 | 100 | | 10.5 |
| F-X | IL17MS2022 | 16A04-9GS-ALB8-9GS-13B03 | 50 | 4.2 | 4.6 |
| F-X | IL17MS2024 | 16A04-9GS-ALB8-9GS-13E02 | 50 | 4.6 | 1.7 |
| A | | mAb02 Fab | 200 | 362.8 | |
| A | | mAb02 IgG | 500 | 112.2 | |
| A | | mAb02 IgG | 100 | 255.6 | |
| F | | B-E52 mAB | 600 | | 643.0 |

Example 23: Sequence Optimisation

Nanobodies IL17MS04G01 (A) (SEQ ID NO: 635), IL17MS16A04 (F) (SEQ ID NO: 648), IL17MS13E02 (X) (SEQ ID NO: 664) and IL17MS13B03 (X) (SEQ ID NO: 662) were taken further for humanisation and sequence optimisation. As such it is still possible to make all formats A-F/F-A, X-F/F-X and X-X. Humanisation is a process in which parental wild type Nanobody® sequences are mutated to yield Nanobody® sequences that are more identical to human VH3-JH germline consensus sequences. Sequence optimization involves replacing one or more specific amino acid residues in the sequence in order to improve one or more (desired) properties of the Nanobodies. Some examples of such sequence optimization are mentioned in the further description herein and for example include, without limitation, substitutions that improve long-term stability or properties under storage, substitutions that increase expression levels in a desired host cell or host organism, and/or substitutions that remove or reduce (undesired) post-translational modification(s) (such as glycosylation or phosphorylation), again depending on the desired host cell or host organism. Specific amino acids, with the exception of the so-called hallmark residues, in the FRs that differ between the Nanobody® and the human VH3-JH germline consensus are altered to the human counterpart in such a way that the protein structure, activity and stability are kept intact. The parental wild type Nanobody® amino acid sequence is also aligned to the llama IGHV germline amino acid sequence of the Nanobody® (identified as the top hit from a BlastP analysis of the Nanobody® against the llama IGHV germlines), and in certain cases mutations towards the llama germline are introduced to increase the stability of the Nanobody, which is defined as camelisation.

For example and without limitation, when the humanisation and sequence optimisation of IL17MS04G01 were investigated, 8 amino acid residues in IL17MS04G01 were found which can be substituted for humanization/camelisation purposes and 1 possible amino acid residue was found which could be substituted for improving chemical stability. In the sequence optimization process of IL17MS04G01, 12 IL17MS04G01 versions (a basic variant and 11 additional variants) were constructed. The basic variant (IL17MS3010) contains 5 substitutions: A14P, A74S, E81Q, K83R and Q108L. In addition to these changes, the E1D, Q18L, T23A and A84P substitutions were introduced and investigated in additional variants. They were assembled from oligonucleotides using a PCR overlap extension method. The constructs were expressed in *E. coli* and purified by IMAC and desalting.

A selected number of variants were were evaluated for their hIL-17 binding capacity by surface plasmon resonance and for their neutralizing activity in Alphascreen. Also thermal stability of the variants was tested in either DSC or in a thermal shift assay using the Lightcycler (Roche). In this assay the Nanobodies variants are incubated at different pH's in the presence of sypro orange and a temperature gradient is applied. When the Nanobodies start denaturing, sypro orange binds and the measured fluorescence increases suddenly, as such a melting temperature can be determined for a certain pH. The analysis occurred in two rounds, in a first round single mutations and combined mutations upon the basic variants were evaluated, and based upond these results, two final variants were made were influence of the E1D mutation was studied. These mutation is introduced to prevent possible pyroglutamate formation. Results are summarized in Table 23 and 24.

In Tables 24, 26, 28, 30, 33 and 34:

- "IC50 cell based assay hIL-17A" and "IC50 hIL17A", respectively, refer to the cell based assay using hIL-17A described in Example 9;
- "IC50 cell based assay hIL-17F" and "IC50 hIL17F", respectively, refer to the cell based assay using hIL-17F described in Example 9;
- "IC50 cell based assay hIL-17A/F" and "IC50 hIL17A/F", respectively, refer to the cell based assay using hIL-17A/F described in Example 9.

In the receptor blocking assays, it was found that all variations are well tolerated without significant changes in potency (maximum 2 fold difference compared to Wild type). Also the off-rate data are in the same range as the Wild type. Q18L and A84P have a positive effect on the Tm. However T23A has a negative effect on Tm and was therefore omitted from the final variant.

From the second round analysis (Table 24), it can be concluded that the E1D mutation has no influence on Tm or potency. The Tm of IL17MS3060 is 7° C. higher than WT, Tm of IL17MS3061 is only 2.5° C. higher than WT, and therefore IL17MS306013015 became the final variant, it's potency in the receptor blocking assay is comparable to wild type and also in the cell based HT-1080 assay on hIL-17A and h-IL17A/F potencies are in the same range of the WT. The off-rates for IL17MS3060 on human IL-17A, human IL-17A/F and cyno IL-17A are similar to the off-rate of the WT. The % framework identity in the framework regions for IL17MS3060 is 88.8% and for IL17MS3015 89.9%, based on the AbM definition (see Antibody Engineering, Vol 2 by Kontermann & Dübel (Eds), Springer Verlag Heidelberg Berlin, 2010).

TABLE 23 results of analysis of the first round sequence optimization variants of IL17MS04G01

| ID | Mutation(s) | average IC 50 Alpha-screen IL-17A-IL-17RA (pM) | koff hIL-17A (s−1) | koff IL-17A/F (s−1) | Tm at pH 7 (° C.) TSA | Tm (° C.) DSC |
|---|---|---|---|---|---|---|
| IL17MS04G01 | WT | 93 | 1.80-1.16E−04 | 2.30-1.70E−04 | 73.13-75 | 74.5 |
| IL17MS3010 basic | A14P, A74S, E81Q, K83R, Q108L | 184 | 1.30E−04 | 2.17E−04 | 74.79 | 74.4 |
| IL17MS3011 | basic + Q18L | 139 | 1.32E−04 | 2.23E−04 | 77.28 | |
| IL17MS3012 | basic + T23A | 101 | 1.37E−04 | 2.28E−04 | 71.47 | 69.5 |
| IL17MS3013 | basic + A84P | 81 | 1.16E−04 | 1.85E−04 | 78.11 | 76.3 |
| IL17MS3015 | basic + Q18L, A84P | 171 | | | | 79.8 |
| IL17MS3016 | basic + T23A, A84P | 177 | | | | 72.7 |
| IL17MS3017 | basic + Q18L, T23A, A84P | 163 | 1.44E−04 | 2.42E−04 | 76.45 | 76.1 |

TABLE 24

Results of analysis of the second round sequence optimization variants of IL17MS04G01

| ID | Mutations | average IC 50 Alphascreen IL-17A-IL-17RA (pM) | IC50 cell based assay hIL-17A (pM) | IC50 cell based assay hIL-17A/F (pM) | IC50 IL-17A-IL-17RA competition ELISA (pM) | koff hIL-17A (s−1) | koff cyno IL-17A (s−1) | koff IL-17A/F (s−1) | Tm at pH 7 (° C.) TSA | Tm (° C.) DSC |
|---|---|---|---|---|---|---|---|---|---|---|
| IL17MS04G01 | WT | 93 | 710 | 7550 | 122 | 1.16E−04 | 3.20E−04 | 1.70-2.30E−04 | 73-75 | 74.5 |
| IL17MS3060 | basic + E1D, Q18L, A84P | 81 | 930 | 5500 | 181 | 1.50E−04 | 1.54E−04 | 2.09E−04 | 81 | 81.6 |
| IL17MS3061 | basic + E1D, Q18L, T23A, A84P | 27 | 940 | 8150 | | 1.46E−04 | 1.81E−04 | 1.95E−04 | 76.5 | 77.6 |

TABLE 25

Results of analysis of sequence optimization variants of IL17MS13B03 selected from a library screen, A-RA = hIL-17A-IL-17RA Alphascreen; F-RC = hIL-17F-IL-17RC Alphascreen

| ID | Mutations (basic = A14P, A74S, K83R, Q108L) | IC50 A-RA fold difference compared to WT | IC50 F-RC fold difference compared to WT | koff (s−1) IL-17A | koff (s−1) IL-17F | koff IL-17A/F (s−1) | Tm at pH 7 (° C.) |
|---|---|---|---|---|---|---|---|
| IL17MS13B03 | WT | 1.0 | 1 | 1.31E−2.08E−04 | 7.92E−03 | 6.21E−05-1.25E−04 | 80 |
| IL17MS3044 | basic + S11L | | | 2.12E−04 | 7.76E−03 | 2.53E−04 | 79 |
| IL17MS3045 | basic + T40A | | | 2.70E−04 | 7.94E−03 | 6.16E−04 | 83 |
| IL17MS3046 | basic + N61A | | | 2.81E−04 | 8.48E−03 | 5.15E−04 | 81 |
| IL17MS3048 | basic + D82aN | | | 2.95E−04 | 8.74E−03 | 6.65E−04 | 81.5 |
| IL17MS3050 | basic + D16G | | | 2.67E−04 | 8.55E−03 | 5.75E−04 | 82 |
| IL17MS3051 | N29F | 1.4 | 0.4 | 2.05E−04 | 2.16E−03 | 3.96E−04 | 75 |
| IL17MS3052 | N29S | 0.9 | 0.5 | 2.89E−04 | 4.39E−03 | 5.18E−04 | 78 |
| IL17MS3053 | S30T | 1.3 | 1.2 | 2.58E−04 | 9.82E−03 | 5.20E−04 | 78 |
| IL17MS3043 | basic + D16G, D79Y | | | 2.76E−04 | 8.11E−03 | 5.85E−04 | 91 |
| IL17MS3049 | basic + T40A, D79Y | | | 1.50E−04 | 7.57E−03 | 2.48E−04 | 91 |
| IL17MS3047 | basic + S11L, D16G, T40A, N61A, D79Y, D82aN | 1.1 | 0.7 | 2.52E−04 | 3.48E−03 | 5.38E−04 | 94.5 |

Similarly and without limitation, when the humanisation and sequence optimisation of IL17MS13B03 (SEQ ID NO 662) were investigated, it was found that 10 amino acid residues in IL17MS13B03 can be substituted for humanization purposes. In this case the basic variant was made, containing mutations A14P, A74S, K83R and Q108L. Then a mini-library of the basic mutant with $2^5*3=96$ permutations at positions 11, 16, 40, 61, 79 and 82aN was constructed. Two additional libraries were constructed to randomize position 29 and 30 to eliminate the deamidation site N29S30.

The libraries were transformed in TG1 and individual colonies were picked and grown in 96 well plates. Periplasmic extracts were prepared, sequenced and screened for off-rates. The mutations do not have an major influence on the off-rates. A selection of constructs was purified to check potency in Alphascreen and to determine Tm. Results are summarized in Table 25.

It was confirmed that most of the investigated mutants do not have a major influence on the potency or on the off-rates of 13B03, only the N29S and N29F mutation seem to improve the potency for human IL-17F. Since N29F causes a drop in the Tm, N29S was chosen to elaborate further.

All other mutations show a slight increase in Tm and the D79Y mutation even provokes an increase of Tm of 11° C. Second round variants were produced where all humanization mutations and the N29S mutation were included. Also the effect of the E1D mutation, to prevent the 20% pyroglutamate formation on position E1, was evaluated. In addition, a F34M mutation was included. Evaluation occurred through measuring receptor blocking potency in protein based competition assays and cell based assays, off-rate and Tm determination and is presented in Table 26.

A huge increase in Tm is observed for the new variants, compared to WT. The potency of the variants for IL17A blocking is comparable with the WT, however potencies of the variants for IL-17F have improved significantly. The final variant became IL17MS3067 and IL17MS3068 (containing the E1D mutation in case the Nanobody is N-terminally located in the multivalent construct). The % framework identity in the framework regions for IL17MS3067 is 88.8% and for IL17MS3068 89.9%, based on the AbM definition.

Also, and again without limitation, when the humanisation and sequence optimisation of IL17MS13E02 were investigated, it was found that 8 amino acid residues in IL17MS13E02 can be substituted for humanization/camelisation purposes. In the first round sequence optimization process of IL17M13E02, 16 IL17MS13E02 versions (a basic variant and 15 additional variants) were constructed. The basic variant (IL17MS3018) contains 4 substitutions: A14P, A74S, K83R and Q108L. In addition to these changes, the L37F, K71R, G75K and 176N substitutions were introduced and investigated in additional variants. They were assembled from oligonucleotides using a PCR overlap extension method. A selection of the constructs was expressed in *E. coli* and purified by IMAC and desalting for further analysis.

In order to eliminate PTM sites, four libraries were constructed to randomize position M34, M78, D100c and S100D. The libraries were transformed in TG1 and individual colonies were picked and grown in 96 well plates. Periplasmic extracts were prepared, sequenced and screened for off-rates. Based on the results the following mutants were chosen for further investigation as purified protein: M34L, M34V, M78L, M78V, S100dT and S100dA. Results are summarized in Table 27.

TABLE 26

Results of analysis of second round sequence optimization variants of IL17MS13B03; A-RA = hIL-17A-IL-17RA Alphascreen; F-RC = hIL-17F-IL-17RC Alphascreen

| ID | Mutations (Basic = A14P, A74S, K83R, Q108L) | IC50 A-RA fold difference compared to WT | IC50 F-RC fold difference compared to WT | IC50 A-RA competition ELISA | IC50 F-RC competition ELISA | IC50 cell based assay hIL17A (nM) | IC50 cell based assay hIL17F (nM) | IC50 cell based assay cyno IL17F (nM) |
|---|---|---|---|---|---|---|---|---|
| IL17MS13B03 | WT | 1.0 | 1.0 | 131 | 7042 | 1.34 | 35 | 29 +/− 15 |
| IL17MS3066 | basic + E1D, S11L, | 0.7 | 0.3 | | | | | |

TABLE 26-continued

Results of analysis of second round sequence optimization variants of IL17MS13B03; A-RA = hIL-17A-IL-17RA Alphascreen; F-RC = hIL-17F-IL-17RC Alphascreen

| | | | | | | | | |
|---|---|---|---|---|---|---|---|---|
| | D16G, N29S, T40A, N61D, D79Y, D82aN | | | | | | | |
| IL17MS3068 | basic + S11L, D16G, N29S, F34M, T40A, N61D, D79Y, D82aN | 1.2 | 0.2 | | | | | |
| IL17MS3067 | basic + E1D, S11L, D16G, N29S, F34M, T40A, N61D, D79Y, D82aN | 1.3 | 0.2 | 333 | 2301 | 0.7 | 35.0 | 13 +/− 5 |

| ID | IC50 cell based assay hIL17A/F (nM) | koff hIL17A (s−1) | koff cyno IL17A (s−1) | koff hIL17F (s−1) | koff cyno IL17F (s−1) | koff hIL17A/F (s−1) | Tm at pH 7 (° C.) | Tm DSC (° C.) |
|---|---|---|---|---|---|---|---|---|
| IL17MS13B03 | 4.32 | 1.31-2.08E−04 | 1.14E−04 | 7.92E−03 | 4.69E−03 | 6.21E−05-1.25E−04 | 80 | 81 |
| IL17MS3066 | | | | | | | 96 | |
| IL17MS3068 | | | | | | | 99 | 100 |
| IL17MS3067 | 1.8 | 1.33E−04 | 1.26E−04 | 1.38E−03 | 1.66E−03 | 1.83E−04 | 99 | 100 |

TABLE 27

Results of analysis of sequence optimization variants of IL17MS13E02; A-RA = hIL-17A-IL-17RA Alphascreen; F-RC = hIL-17F-IL-17RC Alphascreen

| ID | Mutation(s) (basic = A14P, A74S, K83R, Q108L) | IC50 A-RA fold difference vs WT | IC50 F-RC fold difference vs WT | koff hIL-17A (s−1) | koff hIL-17F (s−1) | Biacore koff IL-17A/F (s−1) | Tm at pH 7 (° C.) |
|---|---|---|---|---|---|---|---|
| IL17MS13E02 | WT | 1 | 1 | 1.14E−04 | 2.23E−03 | 3.97E−05 | 66 |
| IL17MS3018 basic | A14P, A74S, K83R, Q108L | 1.13 | 0.8 | 9.26E−05 | 2.67E−03 | 1.38E−05 | 67 |
| IL17MS3019 | basic + L37F | 3.72 | 4.6 | 7.45E−04 | 3.49E−02 | 3.10E−04 | 74.39 |
| IL17MS3020 | basic + K71R | 1.24 | 1.3 | 2.84E−05 | 1.47E−03 | <1E−06* | 67.34 |
| IL17MS3021 | basic + G75K | 2.75 | 0.9 | 2.16E−04 | 4.32E−03 | 6.43E−05 | 64.02 |
| IL17MS3022 | basic + I76N | 1.17 | 0.9 | 6.41E−05 | 2.40E−03 | 9.89E−06 | 70.24 |
| IL17MS3027 | basic + K71R, I76N | 1.23 | 0.6 | | 1.30E−03 | | 70.6 |
| IL17MS3032 | basic + K71R, G75K, I76N | 1.42 | 0.5 | | 8.30E−04 | | 72.7 |
| IL17MS3034 | M34L | 1.68 | 2.7 | 1.16E−04 | 5.96E−03 | 4.02E−05 | 63.93 |
| IL17MS3038 | M34V | | 3.2 | 2.25E−04 | 1.01E−02 | 6.82E−05 | 62 |
| IL17MS3035 | M78L | 2 | 1.22 | 7.59E−05 | 4.31E−03 | 3.65E−05 | 66.47 |
| IL17MS3039 | M78V | | 1.25 | 2.10E−04 | 5.15E−03 | 4.03E−05 | 66.5 |
| IL17MS3036 | S100dT | 2.06 | 2.2 | 1.32E−04 | 4.40E−03 | 4.31E−05 | 67.71 |
| IL17MS3037 | S100dA | 1.61 | 1 | 1.16E−04 | 3.67E−03 | 4.67E−05 | 68.54 |

TABLE 28

Results of analysis of second round sequence optimization variants of IL17MS13E02; A-RA = hIL-17A-IL-17RA Alphascreen; F-RC = hIL-17F-IL-17RC Alphascreen

| ID | Mutations (basic = A14P, A74S, K83R, Q108L) | IC50 A-RA fold difference vs WT | IC50 F-RC fold difference vs WT | IC50 cell based assay hIL-17A (nM) | IC50 cell based assay hIL-17F (nM) | IC50 cell based assay cyno IL-17F (nM) |
|---|---|---|---|---|---|---|
| IL17MS13E02 | WT | 1 | 1 | 1.73 | 44 +/− 22 | 35 +/− 1 |
| IL17MS3069 | basic + K71R, G75K, I76N, M78L, S100dA | | 0.15 | | | |
| IL17MS3070 | basic + E1D, K71R, G75K, I76N, M78L, S100dA | 0.58 | 0.15 | 0.74 | 18 +/− 10 | 34 −/− 33 |

TABLE 28-continued

Results of analysis of second round sequence optimization variants of IL17MS13E02; A-RA = hIL-17A-IL-17RA Alphascreen; F-RC = hIL-17F-IL-17RC Alphascreen

| | | | | | | |
|---|---|---|---|---|---|---|
| IL17MS3071 | basic + M34L, K71R, G75K, I76N, M78L, S100dA | | 0.3 | | | |
| IL17MS3072 | basic + E1D, M34L, K71R, G75K, I76N, M78L, S100dA | 0.59 | 0.3 | 0.77 | 27 +/− 15 | 25.2 +/− 23 |

| ID | IC50 cell based assay hIL-17A/F (nM) | koff hIL-17A (s−1) | koff cyno IL-17A (s−1) | koff hIL-17F (s−1) | Biacore koff cyno IL-17F (s−1) | Biacore koff IL-17A/F (s−1) | Tm at pH 7 (° C.) | Tm DSC pH 8.8 |
|---|---|---|---|---|---|---|---|---|
| IL17MS13E02 | 1.99 | 1.14E−04 | 1.03E−04 | 2.23E−03 | 4.60E−02 | 3.97E−05 | 66.09 | 70 |
| IL17MS3069 | | | | | | | 75.62 | 78 |
| IL17MS3070 | 1.63 | 6.34E−05 | 5.85E−05 | 1.12E−03 | 1.62E−02 | 7.82E−05 | 75.62 | |
| IL17MS3071 | | | | | | | 73.55 | |
| IL17MS3072 | 3.5 | | | | | | 73.55 | |

The L37F mutation shows a drop in potency in the IL-17A-RA and IL-17F-RC Alphascreen and also the off-rate on IL-17F is affected. Hence, the mutation was not included in the final variant. The other humanization mutations K71R, G75K and 176N do not have a major influence on the potency or on the off-rate and were included in the final variant. Mutation of M34 to V or L decreases the potency of 13E02.

Four second round variants were made of IL17MS3032 containing M78L and S100dA. Mutations M34L and E1D were randomized. Results of the analysis of these variants are represented in Table 28. The E1D mutation has no effect on Tm nor potency. The Tm of all variants is increased with respect to WT (about 9.5° C. or 7.5° C.). The potency of the variants improved compared to WT, with the variant IL17MS3070, not containing the M34L mutation, being the best. Therefore the M34L mutation was not included in the final variants, which became IL17MS3069 and IL17MS3070 (containing the E1D mutation in case the Nanobody is N-terminally located in the multivalent construct) The % framework identity in the framework regions for IL17MS3069 is 92.1% and for IL17MS3070 91%, based on the AbM definition.

Similarly, and again without limitation, when the humanisation and sequence optimisation of IL17MS16A04 were investigated, it was found that 10 amino acid residues in IL17MS16A04 can be substituted for humanization/camelisation purposes. In this case the basic variant was made, containing mutations A14P, K83R and Q108L. Then a mini-library of the basic mutant with $2^7$=128 permutations at positions 48, 61, 63, 65, 74, 82a and 84 was constructed. Two additional libraries were constructed to randomize position 55 and 56 to eliminate the isomeristation site D55S56. The libraries were transformed in TG1 and individual colonies were picked and grown in 96 well plates. Periplasmic extracts were prepared, sequenced and screened for off-rates. A drop in off-rate is observed when introducing the V61D and/or E63V mutation. These mutations will not be included in consecutive variants. For the PTM libraries it was decided to investigated further the mutations D55G, D55E and S56T. In first instance a few mutants were purified, mainly to analyse the Tm, results are summarized in Table 29.

TABLE 29

Results of analysis of sequence optimization variants of IL17MS16A04

| ID | Mutation(s) (basic = A14P, K83R, Q108L) | IC50 IL-17F-IL-17RC Alphascreen fold difference vs WT | koff hIL-17F (s−1) | koff IL-17A/F (s−1) | Tm at pH 7 (° C.) | Tm (° C.) DSC |
|---|---|---|---|---|---|---|
| IL17MS16A04 | WT | 1.0 | 4.05E−04 | 2.40E−03 | 69.44 | 69 |
| IL17MS3040 | D55G | 9.6 | 1.48E−03 | 8.78E−03 | 64.87 | |
| IL17MS3041 | D55E | 2.2 | 6.06E−04 | 4.27E−03 | 66.53 | |
| IL17MS3042 | S56T | 8.6 | 1.21E−03 | 5.00E−03 | 70.68 | |
| IL17MS3055 | basic + D65G, S82aN | | 4.93E−04 | 3.32E−03 | 68.6 | |
| IL17MS3054 | basic + G74S, A84P | | 4.59E−04 | 3.08E−03 | 72.34 | 75.5 |
| IL17MS3056 | basic + I48V, G74S | | 5.14E−04 | 2.88E−03 | 63.62 | |

Without limitation to a specific mechanism, hypothesis or explanation, based on the data it was assumed that D55E is the best mutation with respect to affinity, but gives a small drop in Tm. D55E is a conservative mutation, which was pursued further. D55G is potency wise not a good candidate and gives a large drop in Tm and was dropped. S56T is the best mutation with respect to the Tm, but is potency wise less good.

Also, and again without limitation to a specific mechanism, hypothesis or explanation, based on the data it was noted that IL17MS3056 gives a drop in Tm, which is not seen in IL17MS3054 (which has the G74S mutation in common with IL17MS3056). Since the A84P mutation usually increases stability, the drop in Tm is probably caused by 148V. This was further examined. In a second round, five variants with fixed mutations (basic+D65G, G74S, S82aN and A84P) and randomized mutations (E1D, 148V, D55E, S56T) were made and analysed, of which the results are presented in Table 30.

Analysis of the second round variants confirmed that the 148V mutation caused a drop in the Tm, and also negatively influences the potency. Hence this mutation was omitted from the final variant. The E1D mutation does not influence potency or Tm. Although the potency of all variants decreased compared to WT, IL17MS3063 was considered to be give the best results with respect to potency in a monovalent format. This is not observed in the cell based assays, but this assay is less sensitive than the Alphascreen. The Tm of IL17MS3063 is slightly higher than of the WT. Thus IL17MS3063 (when N-terminally), or a building block based thereon without the E1D mutation (when not N-terminally in the multivalent construct), were selected as the preferred amino acid sequences of the invention for further investigation. The % identity in the framework regions for IL17MS3063 is 86.5% and for IL17MS3063 without the E1D mutation 87.6%, based on the AbM definition.

TABLE 30

Results of analysis of second round sequence optimization variants of IL17MS16A04

| ID | Mutations (basic = A14P, A74S, K83R, Q108L) | IC50 IL-17F-IL-17RC Alphascreen fold difference vs WT | IC50 cell based assay hIL-17F (nM) | IC50 cell based assay cyno IL-17F (nM) | IC50 cell based assay hIL-17A/F (nM) | koff IL-17F (s−1) | koff cyno IL-17F (s−1) | koff IL-17A/F (s−1) | Tm at pH 7 (° C.) | Tm (° C.) DSC |
|---|---|---|---|---|---|---|---|---|---|---|
| IL17MS16A04 | WT | 1.0 | 28 +/− 31 | 7.30 +/− 0.1 | 8.0 | 3.82-4.10E−04 | 6.36E−04 | 2.39-2.50E−03 | 69.4 | 69.0 |
| IL17MS3059 | Basic + E1D, I48V, D55E, D65G, G74S, S82aN, A84P | 6.7 | | | | | | | 66.9 | |
| IL17MS3062 | Basic + I48V, D55E, D65G, G74S, S82aN, A84P | 7.4 | | | | | | | 67.7 | |
| IL17MS3063 | Basic + E1D, D55E, D65G, G74S, S82aN, A84P | 3.7 | 14 +/− 13 | 34.2 +/− 34 | 1.6 | 6.55E−04 | 1.11E−03 | 2.65E−02 | 71.0 | 74.5 |
| IL17MS3064 | Basic + E1D, I48V, S56T, D65G, G74S, S82aN, A84P | 30.3 | | | | | | | 68.9 | |
| IL17MS3065 | Basic + E1D, S56T, D65G, G74S, S82aN, A84P | 12.7 | | | | | | | 73.1 | |

Example 24: Generation and Expression Level Analysis of the Multivalent Sequence Optimised Anti-IL-17 Nanobodies with ALB11 HLE The preferred sequence optimised variants were reformatted in all possible combinations: A-F/F-A, X-F/F-X and X-X, with the ALB-HLE in the middle connected with two 9GS-linkers. As back-up also two A-only formats were generated (see Table 31). The constructs were produced in *Pichia pastoris* as tagless proteins and purified via MEP hypercel or Protein A affinity chromatography, followed by desalting. A copy number screen was performed and expression yields estimated from the clones with the highest copy number (see Table 31).

TABLE 31

Results of expression level analysis of purified multivalent sequence optimised anti-IL-17 Nanobodies with ALB11 HLE

| Nanobody ID | Construct | estimated yield in fermentor (g/L) |
|---|---|---|
| IL17MS3076 | IL17MS3070-9GS-ALB11-9GS-IL17MS3068 | 1.5 |
| IL17MS3077 | IL17MS3067-9GS-ALB11-9GS-IL17MS3069 | 1.5 |
| IL17MS3078 | IL17MS3070-9GS-ALB11-9GS-IL17MS3069 | >1.5 |
| IL17MS3079 | IL17MS3067-9GS-ALB11-9GS-IL17MS3068 | 1 |
| IL17MS3080 | IL17MS3060-9GS-ALB11 | 0.5 |
| IL17MS3081 | ALB11(with E1D)-9GS-IL17MS3015 | <<0.5 |
| IL17MS3082 | IL17MS3060-9GS-ALB11-9GS-IL17MS3063 (without E1D) | <0.5 |
| IL17MS3083 | IL17MS3063-9GS-ALB11-9GS-IL17MS3015 | <0.5 |
| IL17MS3084 | IL17MS3063-9GS-ALB11-9GS-IL17MS3068 | 1.5 |
| IL17MS3085 | IL17MS3067-9GS-ALB11-9GS-IL17MS3063 (without E1D) | 1 |
| IL17MS3086 | IL17MS3063-9GS-ALB11-9GS-IL17MS3069 | 1.5 |
| IL17MS3087 | IL17MS3070-9GS-ALB11-9GS-IL17MS3063 (without E1D) | 1 |

Example 25: Analysis of the Blocking Capacity of the Multivalent Sequence Optimised Anti-IL-17 Nanobodies with ALB11 HLE in a Competition ELISA Using Human IL-17A or IL-17F Potencies were checked in the IL-17A-IL-17RA and IL-17F-IL-17RC competition ELISA, as described in Example 17. IC50 values are presented in Table 32.

TABLE 32

Results of blocking capacity of the purified multivalent sequence optimised anti-IL 17 Nanobodies with ALB11 HLE in competition ELISA; NI = non-inhibiting, nd = not determined

| Specificity | Nanobody ID | parental N-terminal Nanobody | Middle Nanobody | parental C-terminal Nanobody | IC50 comp ELISA IL-17A-IL-17RA (pM) | IC50 comp ELISA IL-17F-IL-17RC (pM) |
|---|---|---|---|---|---|---|
| X-X | IL17MS3076 | 13E02 | ALB11 | 13B03 | 64 | 149 |
| X-X | IL17MS3077 | 13B03 | ALB11 | 13E02 | 62 | 153 |
| X-X | IL17MS3078 | 13E02 | ALB11 | 13E02 | 58 | 143 |
| X-X | IL17MS3079 | 13B03 | ALB11 | 13B03 | 56 | 184 |
| A | IL17MS3080 | 04G01 | | ALB11 | 140 | NI |
| A | IL17MS3081 | ALB11 | | 04G01 | nd | nd |
| A-F | IL17MS3082 | 04G01 | ALB11 | 16A04 | 43 | 100 |
| F-A | IL17MS3083 | 16A04 | ALB11 | 04G01 | 141 | 99 |
| F-X | IL17MS3084 | 16A04 | ALB11 | 13B03 | 29 | 16 |
| X-F | IL17MS3085 | 13B03 | ALB11 | 16A04 | 40 | 20 |
| F-X | IL17MS3086 | 16A04 | ALB11 | 13E02 | 54 | 13 |
| X-F | IL17MS3087 | 13E02 | ALB11 | 16A04 | 88 | 23 |
| X | mAB03 | | | | 50 | 17 |
| A | mAB02 | | | | 1309 | NI |

Example 26: Blocking Activity of Purified Multivalent Sequence Optimised Anti-IL-17 Nanobodies with ALB11 HLE in Cell-Based Assay Using Human IL-17A, IL-17F and IL-17A/F in Presence or Absence of HSA The dose-dependent inhibition of hIL-17A, hIL-17F, hIL-17A/F, cIL-17A, and cIL-17F induced IL-6 secretion by HT-1080 cells was investigated for 5 purified multivalent sequence optimised anti-IL-17 Nanobodies with ALB11 HLE in the HT-1080 bioassay as in Examples 18 and 20.

Results show that the 5 purified multivalent sequence optimised anti-IL-17 Nanobodies tested inhibit hIL-17A, hIL-17F, hIL-17A/F, cIL-17A, and cIL-17F with similar, sub-nanomolar to single-digit nanomolar potencies (Table 33). Potencies and efficacies are similar or better than those observed with the anti-IL-17A and anti-IL-17A/F mAb reference compounds. Furthermore, addition of 100 μM HSA to cultures had no significant impact on the potency of the purified multivalent sequence optimised anti-IL-17 Nanobodies (Table 34 compared to Table 33).

TABLE 33

IC50-values of formatted sequence optimized anti-IL-17 Nanobodies in the HT-1080 bioassay in absence of HSA.

| Nanobody or control | Construct | Cellular assay HT-1080 (1500 cells) IC50 hIL17A[1)] (nM) | Emax (%) | IC50 hIL17F[2)] (nM) | Emax (%) | IC50 hIL17A/F[3)] (nM) | Emax (%) | IC50 Cyno IL17A[4)] (nM) | Emax (%) | IC50 Cyno IL17F[5)] (nM) | Emax (%) |
|---|---|---|---|---|---|---|---|---|---|---|---|
| IL17MS3079 | IL17MS3067-9GS-ALB11-9GS-IL17MS3068 | 0.35 ± 0.08 | 95 ± 2 | 5.4 ± 3 | 82 ± −3 | 0.59 ± 0.25 | 83 ± 26 | 0.35 ± 0.04 | 97 ± 1 | 4.5 ± 4 | 88 ± 20 |
| IL17MS3084 | IL17MS3063-9GS-ALB11-9GS-IL17MS3068 | 0.44 ± 0.03 | 94 ± 1 | 5.5 ± 3 | 85 ± 6 | 1.66 ± 1.2 | 82 ± 23 | 0.37 ± 0.06 | 97 ± 2 | 5.0 ± 2 | 89 ± 16 |
| IL17MS3085 | IL17MS3067-9GS-ALB11-9GS-IL17MS3063 (without E1D) | 0.54 ± 0.16 | 94 ± 1 | 5.8 ± 3 | 87 ± 4 | 0.98 ± 0.5 | 83 ± 21 | 0.44 ± 0.04 | 95 ± 5 | 6.7 ± 1 | 90 ± 11 |
| IL17MS3086 | IL17MS3063-9GS-ALB11-9GS-IL17MS3069 | 0.50 ± 0.13 | 95 ± 1 | 3.4 ± 1 | 84 ± 7 | 1.85 ± 0.7 | 87 ± −23 | 0.35 ± 0.08 | 96 ± 1 | 3.6 ± 3 | 94 ± 11 |
| IL17MS3087 | IL17MS3070-9GS-ALB11-9GS-IL17MS3063 (without E1D) | 0.44 ± 0.01 | 94 ± 2 | 5.8 ± 1 | 84 ± 5 | 1.04 ± 0.2 | 87 ± 24 | 0.39 ± 0.04 | 97 ± 5 | 6.7 ± 2 | 95 ± 5 |
| mAb03 | mAb | 0.89* | 94 | 7.1 ± 0.5 | 88 ± −9 | 1.93* | 102 | 2.8 ± 1.6 | 93 ± 1 | 6.3 ± 1 | 96 ± 18 |
| mAb02 | mAb | 0.74* | 90 | | | 0.95* | 60 | | | | |

Results are expressed as mean ± SD of N experiments.
N = 2 or *N = 1.
final ligand concentration 1 nM;
2) final ligand concentration 15 nM;
3) final ligand concentration 5 nM;
4) final ligand concentration 15 nM;
5) final ligand concentration 1 nM;

TABLE 34

IC50-values of formatted sequence optimized anti-IL-17 Nanobodies in the HT-1080 bioassay in presence of HSA.

| Nanobody or control | Construct | Cellular assay HT-1080 (1500 cells) IC50 hIL17A (nM) | Emax (%) | IC50 hIL17F (nM) | Emax (%) | IC50 hIL17A/F (nM) | Emax (%) | IC50 Cyno IL17A (nM) | Emax (%) | IC50 Cyno IL17F (nM) | Emax (%) |
|---|---|---|---|---|---|---|---|---|---|---|---|
| IL17MS3079 | IL17MS3067-9GS-ALB11-9GS-IL17MS3068 | 0.50 ± 0.03 | 91 ± 1 | 8.5 ± 1 | 87 ± 2 | 1.32 ± 0.3 | 95 ± 11 | 0.40* | 100 | 4.0* | 89 |
| IL17MS3084 | IL17MS3063-9GS-ALB11-9GS-IL17MS3068 | 0.55 ± 0.16 | 93 ± 0 | 5.6 ± 5 | 89 ± 3 | 1.14 ± 0.9 | 96 ± 18 | 0.30* | 98 | 1.1* | 97 |
| IL17MS3085 | IL17MS3067-9GS-ALB11-9GS-IL17MS3063 (without E1D) | 0.73 ± 0.21 | 92 ± 2 | 6.6 ± 6 | 89 ± 4 | 1.58 ± 1.4 | 90 ± 9 | 0.33* | 98 | 8.0* | 80 |
| IL17MS3086 | IL17MS3063-9GS-ALB11-9GS-IL17MS3069 | 0.70 ± 0.20 | 93 ± 0 | 6.0 ± 4 | 91 ± 4 | 2.52 ± 0.09 | 94 ± 15 | 0.33* | 98 | 1.2* | 97 |
| IL17MS3087 | IL17MS3070-9GS-ALB11-9GS-IL17MS3063 (without E1D) | 0.57 ± 0.16 | 91 ± 4 | 6.3 ± 4 | 83 ± 9 | 1.54 ± 1.3 | 88 ± 16 | 0.35* | 94 | 7.0* | 70 |
| mAb03 | mAb | 0.89* | 90 | 8.3 ± 1 | 90 ± 6 | 1.67* | 104 | 2.68* | 90 | 1.9* | 96 |
| mAb02 | mAb | 1.42* | 88 | | | 9.21* | 72 | | | | |

Results are expressed as mean ± SD of N experiments.
N = 2 or *N = 1.

Example 27: Binding of Formatted Sequence Optimised Anti-IL-17 Nanobodies, Carrying the ALB11 HLE, to Human Serum Albumin For the 5 selected formatted sequence optimized anti-IL-17 Nanobodies carrying the ALB11 HLE, off-rates for binding to human serum albumin were determined by surface plasmon resonance, using the Biacore (Table 35). All Nanobodies show similar off-rates ranging from 5.1E-03 to 4.4E-03 s−1, comparable to the wild-type formatted anti-IL-17 Nanobodies

TABLE 35

Affinities for HSA of ALB11 HLE anti-IL-17 formatted sequence optimized

| Nanobodies specificity | Nanobody ID | koff (s−1) |
|---|---|---|
| X-X | IL17MS3079 | 4.40E−03 |
| F-X | IL17MS3084 | 4.60E−03 |
| X-F | IL17MS3085 | 4.60E−03 |
| F-X | IL17MS3086 | 5.00E−03 |
| X-F | IL17MS3087 | 5.10E−03 |

Example 28: Blocking Activity of Purified Multivalent Sequence Optimised Anti-IL-17 Nanobodies Carrying the ALB11 HLE In Vivo in Mice Administered with Recombinant Human IL-17A and IL-17F Although the monovalent and multivalent anti-IL-17 Nanobodies described herein do not recognize mouse IL-17A nor IL-17F, mouse cells are responsive to human recombinant IL-17A and IL-17F (see WO2007/070750, Example 7). Furthermore, recombinant IL-17A or IL-17F administered to normal mice induce a secretion of the chemokine CXCL8 (aka KC for keratinocyte-derived Chemokine) which can be measured in serum at selected time points. The ability of the formatted sequence optimized anti-IL-17 Nanobody carrying the ALB11 HLE Nanobody IL17MS3086 to block in vivo induction of serum KC after injection of recombinant human IL-17A (rhIL-17A) or recombinant human IL-17F (rhIL-17F) was investigated in mice. Each group of five mice received a subcutaneously (s.c) injection of 100 μl PBS, either alone (sham group PBS) or containing 10 μg/mouse of recombinant human IL-17A or IL-17F. Four hours before IL-17 injection, mice were treated intravenously (i.v.) with isotype control antibody, control Nanobody (ALB11) or with anti-human IL-17 Nanobody IL17MS3086 (100 μg, 28.5 μg, 8.1 μg, or 2.3 μg/mouse). The anti-IL-17A monoclonal antibody mAb02, the anti-IL-17F monoclonal antibody mAb B-F60, and dual specific anti-IL17A/F monoclonal antibody mAb03 were used as reference controls. Equimolar doses of antibodies versus Nanobody were used for better comparison (350 μg, 100 μg, 28.5 μg or 8.1 μg antibodies). At two hours after rhIL-17A administration and four hours after rhIL-17F administration, blood was collected and mice sacrificed. The serum was collected and analyzed for KC levels by ELISA.

Both rhIL-17A and rhIL-17F induced and increase in KC levels, although this was more pronounced with rhIL-17A (FIG. 12). The IL17MS3086 Nanobody blocked the ability of rhIL-17A and rhIL-17F to induce KC in mouse serum. Blocking was clearly dose-dependent for rhIL-17A (FIG. 12). At all doses tested, the IL17MS3086 Nanobody blocked the ability of rhIL-17F to induce KC in mouse serum better than the equivalent dose of mAb03 or mAb B-F60. Additionally, the inhibition by the Nanobody was better at equivalent doses to what seen with mAb03 or mAb02 for rhIL-17A, as for example a dose of 8.1 μg of IL17MS3086 significantly neutralized rhIL-17A-induced KC in serum while the same dose of mAb02 or mAb03 (FIG. 12) did not.

Example 29: Affinity Determination of a Formatted Sequence Optimized Anti-IL17 Nanobody with ALB11 HLE Using the KinExA Technology The relative affinity of IL17MS3091 (SEQ ID NO: 838; FIG. 8)—a Myc-HIS tagged variant of the formatted sequence optimized with ALB11 HLE anti-IL-17 Nanobody IL17MS3086—for human and cynomolgus monkey IL-17A and IL-17F was assessed using the KinExA® (Kinetic Exclusion Assay) method for measuring the equilibrium dissociation constant (Kd) in solution. Values of the kinetic binding constants Kon and Koff were not determined.

Range and average Kd values observed with IL17MS3091 (see Table 36) suggest that the parent formatted sequence optimized anti-IL-17 Nanobody IL17MS3086 binds in solution with very strong affinity (single digit pM to sub-pM) to IL-17A and IL-17F, with a slightly better affinity for IL-17A. In addition, there were no significant differences between the Kd observed for human and cynomolgus recombinant cytokines,

TABLE 36

Range and average Kd values observed with IL17MS3091 by KinExA

| | Kd - (picoM) | |
|---|---|---|
| Cytokine | Range Low-High | Average |
| human IL-17A | 0.094-1.02 | 0.4 |
| cynomolgus IL-17A | 0.476-3.14 | 1.37 |
| human IL-17F | 0.146-3.16 | 1.14 |
| cynomolgus IL-17F | 0.360-11.2 | 2.82 |

In comparison, the binding affinity as determined by Biacore of mAb03 for hIL-17A was 15 pM, and for hIL-17F was 10 pM. Hence, a polypeptide with a combination of a Class 3 ISV with a Class 4 ISV results in superior binding affinities compared to conventional antibodies.

Example 30: Species Cross-Reactivity of a Formatted Sequence Optimized Anti-IL17 Nanobody with ALB11 HLE Binding to IL17A and IL17F of other species was assessed for IL17MS3091, a tagged version of IL17MS3086, using a binding ELISA as described in Example 11. IL17MS3091 shows binding to marmoset and cynomolgus IL17A and IL17F. No signals are detected for binding to IL17A from mouse, rat and guinea pig origin nor for binding to IL17F from mouse and rat origin (Table 37 and 38).

TABLE 37

OD values obtained for binding of IL17MS3091 to IL17A of different species in a binding ELISA, signals of positive and negative controls are presented as well.

| Samples | Human IL17A | cyno IL17A | marmoset IL17A | mouse IL17A | rat IL17A | guinea pig IL17A |
|---|---|---|---|---|---|---|
| Negative control | 0.018 | 0.011 | 0.013 | 0.015 | 0.010 | 0.011 |
| Positive controls | 3.979 | 4.085 | 4.122 | 3.628 | 3.641 | —* |
| IL17MS3091 | 1.523 | 2.225 | 2.517 | −0.005 | 0.000 | 0.103 |

*no control available for guinea pig IL17A

TABLE 38

OD values obtained for binding of IL17MS3091 to IL17F of different species in a binding ELISA.

| Samples | Human IL17F | cyno IL17F | marmoset IL17F | mouse IL17F | rat IL17F |
|---|---|---|---|---|---|
| Negative control | 0.017 | 0.021 | 0.020 | 0.046 | 0.037 |
| Positive control | 3.564 | 3.981 | 3.550 | 3.549 | 3.571 |
| IL17MS3091 | 0.741 | 1.314 | 0.573 | −0.034 | −0.027 |

Example 31: Specificity of a Formatted Sequence Optimized Anti-IL17 Nanobody with ALB11 HLE Off-target binding of IL17MS3086 was assessed by measuring the binding capacity of this Nanobody to human IL-17B, IL-17C, IL-17D or IL-17E by SPR as described in Example 12.

Whereas all control antibodies bound to their respective targets, IL17MS3086 did not bind to human IL-17B, IL-17C, IL-17D or IL-17E.

Example 32: Pharmacokinetic Profile of IL17MS3086 in Female Cynomolgus Monkeys The pharmacokinetic profile of IL17MS3086 was determined in female cynomolgus monkey following a single intravenous (i.v.) bolus dose (2 and 6 mg/kg) and after a single subcutaneous (s.c.) dose (6 mg/kg). IL17MS3086 was dosed to three healthy treatment naïve female cynomolgus monkeys per route and per dose level.

For the pharmacokinetic data analysis, descriptive statistics were calculated per route, per dose group and per sampling time point.

Individual plasma concentration-time profiles were subjected to non-compartmental analysis (NCA) using WinNonlin Pro 5.1 (Pharsight Corporation, USA; 2006). The area under the curve (AUC) was estimated using the lin up/log down rule. LLOQ values were treated as missing, except when comprised between two values above the LLOQ (lower limit of quantification), then they were set to zero.

The following main pharmacokinetic parameters were estimated: the plasma concentration at time zero (C0) after i.v. administration or maximum plasma concentration ($C_{max}$) after s.c. administration; the area under the plasma concentration-time curve extrapolated to infinity ($AUC_{inf}$), (apparent) total body clearance (CL for i.v. data, CL/F in case of s.c. data), volume of distribution at steady-state ($Vd_{ss}$) in case of i.v. data only, the terminal half-life ($t_{1/2}$) and the absolute s.c. bioavailability (F).

In case of i.v. data, the concentration at time zero ($C_0$) was estimated through back-calculation based on the two first data points. The terminal elimination half-life (t½) was calculated automatically (best-fit) using a log-linear regression of the non-zero concentration-time data of the log-linear portion of the terminal phase. A minimum of three points were considered for the determination of λz.

In one animal, i.e. No 6317 (i.v., 2 mg/kg) positive ADA titers, as evaluated with a homogeneous electrochemiluminescent bridging MSD assay, correlated with a slope change in the pharmacokinetic profile (from 21 d post-dose onwards). This animal was therefore removed from subsequent PK data analysis.

In FIG. 13, the mean serum concentration-time profiles of IL17MS3086 following a single i.v. bolus dose at 2 and 6 mg/kg or a single s.c. dose at 6 mg/kg, respectively in the female cynomolgus monkey are depicted.

Table 39 lists the main pharmacokinetic parameters and corresponding descriptive statistics, of IL17MS3086 following a single i.v. bolus dose at 2 and 6 mg/kg or a single s.c. dose at 6 mg/kg, respectively in the female cynomolgus monkey.

TABLE 39

Main pharmacokinetic parameters (n = 2 or 3) of IL17MS3086 following a single i.v. bolus dose with 2 and 6 mg/kg (upper panel) or a single s.c. dose with 6 mg/kg (lower panel), respectively in the female cynomolgus monkey.

Single intravenous (i.v.) administration

| Dose level | | $C_0$ (μg/ml) | $AUC_{inf}$ (day * μg/ml | CL (ml/ day/ kg) | $Vd_{ss}$ (ml/kg) | $t_{1/2}$ (day) |
|---|---|---|---|---|---|---|
| 2 mg/kg | N | 2 | 2 | 2 | 2 | 2 |
| | Mean | 46.8 | 218 | 9.17 | 81.0 | 6.05 |
| | SD | NC | NC | NC | NC | NC |
| | Min | 46.2 | 216 | 9.10 | 78.5 | 5.39 |
| | Median | 46.8 | 218 | 9.17 | 81.0 | 6.05 |
| | Max | 47.4 | 220 | 9.24 | 83.4 | 6.71 |
| | CV % | NC | NC | NC | NC | NC |
| 6 mg/kg | N | 3 | 3 | 3 | 3 | 3 |
| | Mean | 181 | 866 | 6.99 | 64.4 | 6.86 |
| | SD | 17.5 | 102 | 0.774 | 9.02 | 1.15 |
| | Min | 168 | 796 | 6.11 | 58.9 | 5.72 |
| | Median | 174 | 818 | 7.34 | 59.6 | 6.86 |
| | Max | 201 | 983 | 7.53 | 74.8 | 8.01 |
| | CV % | 9.67 | 11.8 | 11.1 | 14.0 | 16.7 |

lower panel

Single subcutaneous (i.v.) administration

| Dose level | | $C_{max}$ (μg/ml) | $T_{max}$ (day) | $AUC_{inf}$ (day * μg/ml | CL/F (ml/day/k | $t_{1/2}$ (day) |
|---|---|---|---|---|---|---|
| 6 mg/kg | N | 3 | 3 | 3 | 3 | 3 |
| | Mean | 62.7 | 1.1 | 667 | 9.07 | 6.79 |
| | SD | 10.3 | 0.858 | 76.2 | 0.973 | 0.246 |
| | Min | 52.6 | 0.292 | 623 | 7.95 | 6.61 |
| | Median | 62.3 | 1 | 623 | 9.63 | 6.71 |
| | Max | 73.2 | 2 | 755 | 9.64 | 7.07 |
| | CV % | 16.4 | 78.2 | 11.4 | 10.7 | 3.62 |

NC, not calculated

Following i.v. bolus administration, the pharmacokinetic profile of IL17MS3086 displayed a bi-exponential decline. During the first day after i.v. dosing a distribution phase was apparent. Thereafter IL17MS3086 serum concentrations declined in a mono-exponential fashion. The available data did not suggest target mediated disposition in these healthy monkeys.

After i.v. administration, the exposure to IL17MS3086 ($AUC_{inf}$) increased with increasing dose. The increase in exposure was slightly greater than dose proportional over the 2-6 mg/kg dose range (AUC×3.96 vs dose×3) leading to CL values of 9.17 and 6.99 ml/kg/day at 2 and 6 mg/kg i.v., respectively. Corresponding values of $Vd_{ss}$ were 81.0 and 64.4 ml/kg, respectively suggesting distribution to the tissues. The $t_{1/2}$ was ca 6-7 d, in line with the serum half-life of cynomolgus albumin.

After s.c. administration, $C_{max}$ occurred at 1 d post-dose. No evidence of absorption controlled kinetics ($t_{1/2}$ ca 6.8 versus 6-6.8 d) was apparent after s.c. administration. The absolute s.c. bioavailability was estimated at 77%.

Example 33: In Vivo Efficacy of an Anti-IL-17 A/F Nanobody in a Collagen-Induced Cynomolgus Monkey Model A collagen-induced arthritis (CIA) cynomolgus monkey model was used to assess the in vivo efficacy of IL17MS3086. In brief, 3-6 year old female cynomolgus monkeys of Chinese origin were anesthetized by an intramuscular injection of ketamine hydrochloride (Kamud Drugs Pvt., Ltd 50 mg/ml) and were subsequently sensitized with bovine type II collagen in Freund's complete adjuvant subcutaneously over 19 sites on the back and at one site at the base of the tail. The sensitization procedure was repeated on day 21 of the study. On the same day as the first sensitization and once a week henceforth, the animals were dosed with either 10 mg/kg or 2.8 mg/kg IL17MS3086 (9-10 animals/group) subcutaneously. These two selected doses corresponded to either an equivalent dose (10 mg/kg) or an equimolar dose (2.8 mg/kg) to a dual specific anti-IL17A/F monoclonal antibody mAb03 that was used as reference control and also administered subcutaneously at 10 mg/kg. Additionally, both a negative control group (9 animals until day 28 and 8 animals thereafter) and a positive control group (2 animals) were included. The negative control animals were dosed subcutaneously with formulation buffer whereas the positive control group animals were dosed intravenously with 10 mg/kg of Tocilizumab (RoActemra®), an anti-IL-6R monoclonal antibody, following the same schedule. Tocilizumab was previously shown to effectively reduce arthritis related changes in a similar CIA cynomolgus monkey model (Uchiyama et al, 2008; Biol. Pharm. Bull, 31(6): 1159-1163).

All animals from all groups were observed at least once daily throughout the study duration that lasted 8 weeks following which they were all necropsied. The symptoms of arthritis were evaluated using a visual scoring system and radiography. In addition, C-reactive protein (CRP), an inflammatory parameter, was monitored regularly. Each animal underwent numerous assessments at various time-points that are summarized in Table 40.

TABLE 40

Measured endpoints in the cynomolgus monkey CIA study

| Endpoint | Timepoints | Methods |
|---|---|---|
| Arthritis | Acclimation: Day −4 of sensitization<br>Dosing period: Days 7 14, 21, 28, 35, 42, 49, 56 | Swelling of the metacarpophalangeal, proximal interphalangeal distal interphalangeal joints and the wrist, ankle, elbow and knee joints was evaluated blindly and scored as follows: 0 = No abnormality, 1 = Swelling not visible but can be determined by touch, 2 = Swelling slightly visible and can be determined by touch, 3 = Swelling clearly visible and joint can be completetly flexed, 4 = Swelling clearly visible but joint cannot be completely flexed, 5 = Rigidity of the joints. The arthritis score of each animal is the total of the swelling scores for the individual joints. |
| General condition | Acclimation: Day −4 of sensitization<br>Dosing period: Days 7, 14, 21, 28, 35, 42, 49, 56 | The general condition of each animal was scored as follows: 0 = No abnormality, 1 = Difficulty in hanging from the bars of the cage by the fingers, 2 = Inability to hang from the bars of the cage by the fingers (using wrists), 3 = Movement only by using forelimbs or hindlimbs, 4 = Crouching, 5 = Abnormal body position. |
| X-ray examination | Acclimation: Day −4 of sensitization<br>Dosing period: Days 28, 56 | X-ray images were taken, whilst the animal was under ketamine hydrochloride anesthes'a, us' g an X-ray TV system (DREX-WIN64, Toshiba Medical Systems Corporation). The images were then examined to determine the condition of the joints of the hands and feet (metacarpophalangeal, proximal interphalangeal and distal interphalangeal joints of all fingers except the first finger-48 joints/animal). Each joint with a narrowing of the joint space and/or atrophy was given a score of 1. Similarly when bone erosion or architectural joint destruction was present the joint was given a score of 1. The total score for each parameter was then determined. |
| Body weight | Acclimation: Day −1 of sensitization<br>Dosing period: Days 7, 14, 21, 28, 35, 42, 49, 56 | All the animals were weighed using an electronic balance (HP-40K, A&D Co., Ltd.) |
| Clinical signs | Daily | All animals were observed throughout the duration of the study for clinical signs and mortality. Behaviour, Consciousness, position neurological examination, respiration, body temperature, pulse, stool, urine, vomiting/salivation and skin/fur/mucosa were observed as necessary |
| Blood CRP levels | Acclimation: Day −6 of sensitization<br>Dosing period: Days 7, 14, 21, 28, 35, 42, 49, 56 | The serum CRP levels were determined in a latex turbidimetric immunoassay using an automatic analyzer (JCA-BM6070, JEOL Ltd.) and expressed as mg/dL. |
| Histopathology | Following necropsy on day 57 | After collection the skin of the carpal and tarsal joint and digits were cut with scissors before being excised and fixed in 10% neutral buffered formalin. Following delipidation in ethanol and decalcification in EDTA decalcification solution, the joints were paraffin-embedded and prepared for sectioning. The slides were subsequently stained with hematoxylin-eosin and safranin-O before being microscopically examined. |

The sensitization with bovine type II collagen effectively led to progressive joint stiffness and swelling that reached a maximum on day 56, as measured by the arthritic score in the negative control group animals. In contrast, the IL17MS3086, mAb03 and positive control treated animals displayed a significant ($p<0.01$) reduction in arthritic scores (FIG. 14) which were paralleled by a mild reduction in serum CRP levels, although these levels were not reduced to the extent of that of the positive control group animals (FIG. 15).

Additionally, radiological examination of the affected joints at the end of the study showed that IL17MS3086-treatment significantly reduced bone erosion and architectural joint destruction (Score B) ($p<0.01$) and to a lesser extent joint space narrowing (Score A) (FIG. 16) which are hallmarks of arthritis (Van der Heijde et al., 1995; J. Rheumatol. 22(9): 1792-1796). The protective effect of IL17MS3086 on pathological joint changes was further confirmed by histological examination of the joints following necropsy. The joint sections were scored for several parameters which are closely linked to the biology of IL-17A and IL-17F and are indicative of joint inflammation and bone remodeling based on the criteria depicted in Table 41. The results showed that the incidence of severe grades was decreased following IL17MS3086-treatment for all findings similarly to that seen after mAb03-treatment or positive control-treatment and that they were equally effective in that respect (FIG. 17).

As a result of the improvement seen on joint stiffness, swelling and damage the IL17MS3086-treated animals had a concomitantly improved general condition score which was indicative of a lesser discomfort and an improved joint mobility in comparison to the buffer-treated animals (FIG. 18). Finally, the drop in body-weights for the IL17MS3086-treated animals at the end of the study, in comparison to the initial body-weights, were within 5% similarly to the mAb03-treated animals, whereas the body weights dropped by 14%±2.5% (mean±SEM) for the buffer-treated animals.

All these findings are consistent with a decreased disease severity in the IL17MS3086-treated and mAb03-treated animals and demonstrated that IL17MS3086-treatment improved the arthritis in this established CIA monkey model. Interestingly, no dose-dependency was observed for the IL17MS3086-treated animals for the assessed endpoints likely indicating that the 2.8 mg/kg dose already gives maximal efficacy which was similar to that of the 10 mg/kg dose of mAb03.

The blocking activity study in mice of Example 28 shows a dose effect of IL17MS3086 inhibiting IL-17A induced KC serum levels. In FIG. 12A (with doses adjusted to μg/kg), a dose of ~0.1 mg/kg (2.3 μg/mouse) reduces KC serum levels significantly. A dose of ~0.4 mg/kg (8.1 μg/mouse) or ~1.4 mg/kg (28.5 μg/mouse) further reduces the KC serum levels. However, it appears that already 0.4 mg/kg IL17MS3086 is saturating, i.e. a plateau is reached in that 1.4 mg/kg IL17MS308628 only reduces KC serum levels only minimally. In contrast, mAb03 was not saturating in this study.

In the present Cynomolgus CIA study 2.8 mg/kg and 10 mg/kg IL17MS3086 were used, which in analogy are also saturating, while mAb03 would not be.

Accordingly, IL17MS2086 appears also more efficacious in the present study.

TABLE 41

Scoring criteria for histological analysis

| Findings | Grade | Criteria |
|---|---|---|
| Hyperplasia in synovial cells | + | Increase in synovial cells |
| | 2+ | Marked increase in synovial cells |
| Granulation tissue morphogenesis* | ± | Granulation tissue in less than 30% of joint cavity |
| | + | Granulation tissue in 30% to 80% of joint cavity |
| | 2+ | Granulation tissue in more than 80% of joint cavity |
| Fibrosis | + | Sparse fibre and abundant cell content |
| | 2+ | Abundant and dense fibre, and scarce cell content |
| Degeneration of joint cartilage | ± | Rough surface of joint cartilage, and disappearance of circular and spindle chondrocytes in cartilage |
| | + | Acidophilic joint cartilage, degenerative necrosis of chondrocytes, and partial destruction |
| | 2+ | Wide range destruction of existing joint cartilage |
| Osteoclasia | + | Partial bone destruction |
| | 2+ | Bone destruction in the medullary cavity |
| Osteogenesis | + | Increase in osteoblasts and neogenesis in bone |
| Neutrophil infiltration | ± | Minimal infiltration |
| | + | Moderate infiltration |
| | 2+ | Marked infiltration |

SEQUENCE LISTING (900 sequences)

SEQ ID NO: 1 - protein, 102 aa, Artificial Sequence
  Description of Artificial Sequence: Synthetic polypeptide
  Nanobody sequence
  MOD_RES (31)..(35): Any amino acid and this region encompasses a CDR portion of the sequence
  MOD_RES (50)..(54): Any amino acid and this region encompasses a CDR portion of the sequence
  MOD_RES (87)..(91): Any amino acid and this region encompasses a CDR portion of the sequence
EVQLVESGGGLVQPGGSLRLSCAASGIPFSXXXXXWFRQAPGKQRDSVAXXXXXRFTISRDNAKNTVYLQMNSLKPEDTAVYRCYFXXXXXWGQGTQVTVSS

SEQ ID NO: 2 - protein, 102 aa, Artificial Sequence
  Description of Artificial Sequence: Synthetic polypeptide
  KERE-class Nanobody
  MOD_RES (31)..(35): Any amino acid and this region encompasses a CDR portion of the sequence
  MOD_RES (50)..(54): Any amino acid and this region encompasses a CDR portion of the sequence
  MOD_RES (87)..(91): Any amino acid and this region encompasses a CDR portion of the sequence
QVKLEESGGGLVQAGGSLRLSCVGSGRTFSXXXXXWFRLAPGKEREFVAXXXXXRFTISRDTASNRGYLHMNNLTPEDTAVYYCAAXXXXXWGQGTQVTVSS

SEQ ID NO: 3 - protein, 102 aa, Artificial Sequence
  Description of Artificial Sequence: Synthetic polypeptide
  KERE-class Nanobody
  MOD_RES (31)..(35): Any amino acid and this region encompasses a CDR portion of the sequence
  MOD_RES (50)..(54): Any amino acid and this region encompasses a CDR portion of the sequence
  MOD_RES (87)..(91): Any amino acid and this region encompasses a CDR portion of the sequence
AVQLVDSGGGLVQAGDSLKLSCALTGGAFTXXXXXWFRQTPGREREFVAXXXXXRFTISRDNAKNMVYLRMNSLIPEDAAVYSCAAXXXXXWGQGTLVTVSS

SEQ ID NO: 4 - protein, 102 aa, Artificial Sequence
  Description of Artificial Sequence: Synthetic polypeptide
  KERE-class Nanobody
  MOD_RES (31)..(35): Any amino acid and this region encompasses a CDR portion of the sequence
  MOD_RES (50)..(54): Any amino acid and this region encompasses a CDR portion of the sequence
  MOD_RES (87)..(91): Any amino acid and this region encompasses a CDR portion of the sequence
QVQLVESGGGLVEAGGSLRLSCTASESPFRXXXXXWFRQTSGQEREFVAXXXXXRFTISRDDAKNTVWLHGSTLKPEDTAVYYCAAXXXXXWGQGTQVTVSS

SEQ ID NO: 5 - protein, 102 aa, Artificial Sequence
  Description of Artificial Sequence: Synthetic polypeptide
  KERE-class Nanobody
  MOD_RES (31)..(35): Any amino acid and this region encompasses a CDR portion of the sequence
  MOD_RES (50)..(54): Any amino acid and this region encompasses a CDR portion of the sequence
  MOD_RES (87)..(91): Any amino acid and this region encompasses a CDR portion of the sequence
AVQLVESGGGLVQGGGSLRLACAASERIFDXXXXXWYRQGPGNERELVAXXXXXRFTISMDYTKQTVYLHMNSLRPEDTGLYYCKIXXXXXWGQGTQVTVSS

SEQ ID NO: 6 - protein, 102 aa, Artificial Sequence
  Description of Artificial Sequence: Synthetic polypeptide
  KERE-class Nanobody
  MOD_RES (31)..(35): Any amino acid and this region encompasses a CDR portion of the sequence
  MOD_RES (50)..(54): Any amino acid and this region encompasses a CDR portion of the sequence
  MOD_RES (87)..(91): Any amino acid and this region encompasses a CDR portion of the sequence
DVKFVESGGGLVQAGGSLRLSCVASGFNFDXXXXXWFRQAPGKEREEVAXXXXXRFTISSEKDKNSVYLQMNSLKPEDTALYICAGXXXXXWGRGTQVTVSS

SEQ ID NO: 7 - protein, 102 aa, Artificial Sequence
  Description of Artificial Sequence: Synthetic polypeptide
  KERE-class Nanobody
  MOD_RES (31)..(35): Any amino acid and this region encompasses a CDR portion of the sequence
  MOD_RES (50)..(54): Any amino acid and this region encompasses a CDR portion of the sequence
  MOD_RES (87)..(91): Any amino acid and this region encompasses a CDR portion of the sequence
QVRLAESGGGLVQSGGSLRLSCVASGSTYTXXXXXWYRQYPGKQRALVAXXXXXRFTIARDSTKDTFCLQMNNLKPEDTAVYYCYAXXXXXWGQGTQVTVSS

SEQ ID NO: 8 - protein, 102 aa, Artificial Sequence
  Description of Artificial Sequence: Synthetic polypeptide
  KERE-class Nanobody
  MOD_RES (31)..(35): Any amino acid and this region encompasses a CDR portion of the sequence
  MOD_RES (50)..(54): Any amino acid and this region encompasses a CDR portion of the sequence
  MOD_RES (87)..(91): Any amino acid and this region encompasses a CDR portion of the sequence
EVQLVESGGGLVQAGGSLRLSCAASGFTSDXXXXXWFRQAPGKPREGVSXXXXXRFTISTDNAKNTVHLLMNRVNAEDTALYYCAVXXXXXWGRGTRVTVSS

SEQ ID NO: 9 - protein, 102 aa, Artificial Sequence
  Description of Artificial Sequence: Synthetic polypeptide
  KERE-class Nanobody
  MOD_RES (31)..(35): Any amino acid and this region encompasses a CDR portion of the sequence
  MOD_RES (50)..(54): Any amino acid and this region encompasses a CDR portion of the sequence
  MOD_RES (87)..(91): Any amino acid and this region encompasses a CDR portion of the sequence
QVQLVESGGGLVQPGGSLRLSCQASGDISTXXXXXWYRQVPGKLREFVAXXXXXRFTISGDNAKRAIYLQMNNLKPDDTAVYYCNRXXXXXWGQGTQVTVSP

SEQ ID NO: 10 - protein, 102 aa, Artificial Sequence
  Description of Artificial Sequence: Synthetic polypeptide
  KERE-class Nanobody
  MOD_RES (31)..(35): Any amino acid and this region encompasses a CDR portion of the sequence
  MOD_RES (50)..(54): Any amino acid and this region encompasses a CDR portion of the sequence
  MOD_RES (87)..(91): Any amino acid and this region encompasses a CDR portion of the sequence
QVPVVESGGGLVQAGDSLRLFCAVPSFTSTXXXXXWFRQAPGKEREFVAXXXXXRFTISRNATKNTLTLRMDSLKPEDTAVYYCAAXXXXXWGQGTQVTVSS

SEQ ID NO: 11 - protein, 102 aa, Artificial Sequence
  Description of Artificial Sequence: Synthetic polypeptide
  KERE-class Nanobody
  MOD_RES (31)..(35): Any amino acid and this region encompasses a CDR portion of the sequence
  MOD_RES (50)..(54): Any amino acid and this region encompasses a CDR portion of the sequence
  MOD_RES (87)..(91): Any amino acid and this region encompasses a CDR portion of the sequence
EVQLVESGGGLVQAGDSLRLFCTVSGGTASXXXXXWFRQAPGEKREFVAXXXXXRFTIARENAGNMVYLQMNNLKPDDTALYTCAAXXXXXWGRGTQVTVSS

SEQ ID NO: 12 - protein, 102 aa, Artificial Sequence
  Description of Artificial Sequence: Synthetic polypeptide
  KERE-class Nanobody
  MOD_RES (31)..(35): Any amino acid and this region encompasses a CDR portion of the sequence
  MOD_RES (50)..(54): Any amino acid and this region encompasses a CDR portion of the sequence
  MOD_RES (87)..(91): Any amino acid and this region encompasses a CDR portion of the sequence
AVQLVESGGDSVQPGDSQTLSCAASGRTNSXXXXXWFRQAPGKERVFLAXXXXXRFTISRDSAKNMMYLQMNNLKPQDTAVYYCAAXXXXXWGQGTQVTVSS

SEQ ID NO: 13 - protein, 102 aa, Artificial Sequence
  Description of Artificial Sequence: Synthetic polypeptide
  KERE-class Nanobody
  MOD_RES (31)..(35): Any amino acid and this region encompasses a CDR portion of the sequence
  MOD_RES (50)..(54): Any amino acid and this region encompasses a CDR portion of the sequence
  MOD_RES (87)..(91): Any amino acid and this region encompasses a CDR portion of the sequence
AVQLVESGGGLVQAGGSLRLSCVVSGLTSSXXXXXWFRQTPWQERDFVAXXXXXRFTISRDNYKDTVLLEMNFLKPEDTAIYYCAAXXXXXWGQGTQVTVSS

SEQ ID NO: 14 - protein, 102 aa, Artificial Sequence
  Description of Artificial Sequence: Synthetic polypeptide
  KERE-class Nanobody
  MOD_RES (31)..(35): Any amino acid and this region encompasses a CDR portion of the sequence
  MOD_RES (50)..(54): Any amino acid and this region encompasses a CDR portion of the sequence
  MOD_RES (87)..(91): Any amino acid and this region encompasses a CDR portion of the sequence
AVQLVESGGGLVQAGASLRLSCATSTRTLDXXXXXWFRQAPGRDREFVAXXXXXRFTVSRDSAENTVALQMNSLKPEDTAVYYCAAXXXXXWGQGTRVTVSS

SEQ ID NO: 15 - protein, 102 aa, Artificial Sequence
  Description of Artificial Sequence: Synthetic polypeptide
  KERE-class Nanobody
  MOD_RES (31)..(35): Any amino acid and this region encompasses a CDR portion of the sequence
  MOD_RES (50)..(54): Any amino acid and this region encompasses a CDR portion of the sequence
  MOD_RES (87)..(91): Any amino acid and this region encompasses a CDR portion of the sequence
QVQLVESGGGLVQPGGSLRLSCTVSRLTAHXXXXXWFRQAPGKEREAVSXXXXXRFTISRDYAGNTAFLQMDSLKPEDTGVYYCATXXXXXWGQGTQVTVSS

SEQ ID NO: 16 - protein, 102 aa, Artificial Sequence
  Description of Artificial Sequence: Synthetic polypeptide
  KERE-class Nanobody
  MOD_RES (31)..(35): Any amino acid and this region encompasses a CDR portion of the sequence
  MOD_RES (50)..(54): Any amino acid and this region encompasses a CDR portion of the sequence
  MOD_RES (87)..(91): Any amino acid and this region encompasses a CDR portion of the sequence
EVQLVESGGELVQAGGSLKLSCTASGRNFVXXXXXWFRRAPGKEREFVAXXXXXRFTVSRDNGKNTAYLRMNSLKPEDTADYYCAVXXXXXLGSGTQVTVSS

SEQ ID NO: 17 - protein, 102 aa, Artificial Sequence
  Description of Artificial Sequence: Synthetic polypeptide
  GLEW-class Nanobody
  MOD_RES (31)..(35): Any amino acid and this region encompasses a CDR portion of the sequence
  MOD_RES (50)..(54): Any amino acid and this region encompasses a CDR portion of the sequence
  MOD_RES (87)..(91): Any amino acid and this region encompasses a CDR portion of the sequence
AVQLVESGGGLVQPGGSLRLSCAASGFTFSXXXXXWVRQAPGKVLEWVSXXXXXRFTISRDNAKNTLYLQMNSLKPEDTAVYYCVKXXXXXGSQGTQVTVSS

SEQ ID NO: 18 - protein, 102 aa, Artificial Sequence
  Description of Artificial Sequence: Synthetic polypeptide
  GLEW-class Nanobody
  MOD_RES (31)..(35): Any amino acid and this region encompasses a CDR portion of the sequence
  MOD_RES (50)..(54): Any amino acid and this region encompasses a CDR portion of the sequence
  MOD_RES (87)..(91): Any amino acid and this region encompasses a CDR portion of the sequence
EVQLVESGGGLVQPGGSLRLSCVCVSSGCTXXXXXWVRQAPGKAEEWVSXXXXXRFKISRDNAKKTLYLQMNSLGPEDTAMYYCQRXXXXXRGQGTQVTVSS

SEQ ID NO: 19 - protein, 102 aa, Artificial Sequence
  Description of Artificial Sequence: Synthetic polypeptide
  GLEW-class Nanobody
  MOD_RES (31)..(35): Any amino acid and this region encompasses a CDR portion of the sequence
  MOD_RES (50)..(54): Any amino acid and this region encompasses a CDR portion of the sequence
  MOD_RES (87)..(91): Any amino acid and this region encompasses a CDR portion of the sequence
EVQLVESGGGLALPGGSLTLSCVFSGSTFSXXXXXWVRHTPGKAEEWVSXXXXXRFTISRDNAKNTLYLEMNSLSPEDTAMYYCGRXXXXXRSKGIQVTVSS

SEQ ID NO: 20 - protein, 102 aa, Artificial Sequence
  Description of Artificial Sequence: Synthetic polypeptide
  P,R,S 103-class Nanobody
  MOD_RES (31)..(35): Any amino acid and this region encompasses a CDR portion of the sequence
  MOD_RES (50)..(54): Any amino acid and this region encompasses a CDR portion of the sequence
  MOD_RES (87)..(91): Any amino acid and this region encompasses a CDR portion of the sequence
AVQLVESGGGLVQAGGSLRLSCAASGRTFSXXXXXWFRQAPGKEREFVAXXXXXRFTISRDNAKNTVYLQMNSLKPEDTAVYYCAAXXXXXRGQGTQVTVSS

SEQ ID NO: 21 - protein, 102 aa, Artificial Sequence
  Description of Artificial Sequence: Synthetic polypeptide
  P,R,S 103-class Nanobody
  MOD_RES (31)..(35): Any amino acid and this region encompasses a CDR portion of the sequence
  MOD_RES (50)..(54): Any amino acid and this region encompasses a CDR portion of the sequence
  MOD_RES (87)..(91): Any amino acid and this region encompasses a CDR portion of the sequence
DVQLVESGGDLVQPGGSLRLSCAASGFSFDXXXXXWLRQTPGKGLEWVGXXXXXRFTISRDNAKNMLYLHLNNLKSEDTAVYYCRRXXXXXLGQGTQVTVSS

SEQ ID NO: 22 - protein, 102 aa, Artificial Sequence; identical to SEQ ID NO: 18
  Description of Artificial Sequence: Synthetic polypeptide
  P,R,S 103-class Nanobody
  MOD_RES (31)..(35): Any amino acid and this region encompasses a CDR portion of the sequence
  MOD_RES (50)..(54): Any amino acid and this region encompasses a CDR portion of the sequence
  MOD_RES (87)..(91): Any amino acid and this region encompasses a CDR portion of the sequence

SEQ ID NO: 23 - protein, 30 aa, Artificial Sequence
  Description of Artificial Sequence: Synthetic polypeptide
  KERE-class Nanobody FW1 sequence
QVQRVESGGGLVQAGGSLRLSCAASGRTSS

SEQ ID NO: 24 - protein, 30 aa, Artificial Sequence
  Description of Artificial Sequence: Synthetic polypeptide
  KERE-class Nanobody FW1 sequence
QVQLVESGGGLVQTGDSLSLSCSASGRTFS

SEQ ID NO: 25 - protein, 30 aa, Artificial Sequence
  Description of Artificial Sequence: Synthetic polypeptide
  KERE-class Nanobody FW1 sequence
QVKLEESGGGLVQAGDSLRLSCAATGRAFG

SEQ ID NO: 26 - protein, 30 aa, Artificial Sequence
  Description of Artificial Sequence: Synthetic polypeptide
  KERE-class Nanobody FW1 sequence
AVQLVESGGGLVQPGESLGLSCVASGRDFV

SEQ ID NO: 27 - protein, 30 aa, Artificial Sequence
  Description of Artificial Sequence: Synthetic polypeptide
  KERE-class Nanobody FW1 sequence
EVQLVESGGGLVQAGGSLRLSCEVLGRTAG

SEQ ID NO: 28 - protein, 30 aa, Artificial Sequence
  Description of Artificial Sequence: Synthetic polypeptide
  KERE-class Nanobody FW1 sequence
QVQLVESGGGWVQPGGSLRLSCAASETILS

SEQ ID NO: 29 - protein, 30 aa, Artificial Sequence
  Description of Artificial Sequence: Synthetic polypeptide
  KERE-class Nanobody FW1 sequence
QVQLVESGGGTVQPGGSLNLSCVASGNTFN

SEQ ID NO: 30 - protein, 30 aa, Artificial Sequence
  Description of Artificial Sequence: Synthetic polypeptide
  KERE-class Nanobody FW1 sequence
EVQLVESGGGLAQPGGSLQLSCSAPGFTLD

SEQ ID NO: 31 - protein, 30 aa, Artificial Sequence
  Description of Artificial Sequence: Synthetic polypeptide
  KERE-class Nanobody FW1 sequence
AQELEESGGGLVQAGGSLRLSCAASGRTFN

SEQ ID NO: 32 - protein, 22 aa, Artificial Sequence
  Description of Artificial Sequence: Synthetic peptide
  KERE-class Nanobody FW1 sequence
VESGGGLVQPGGSLRLSCAASG

SEQ ID NO: 33 - protein, 22 aa, Artificial Sequence
  Description of Artificial Sequence: Synthetic peptide
  KERE-class Nanobody FW1 sequence
VDSGGGLVQAGDSLKLSCALTG

SEQ ID NO: 34 - protein, 22 aa, Artificial Sequence
  Description of Artificial Sequence: Synthetic peptide
  KERE-class Nanobody FW1 sequence
VDSGGGLVQAGDSLRLSCAASG

SEQ ID NO: 35 - protein, 22 aa, Artificial Sequence
  Description of Artificial Sequence: Synthetic peptide
  KERE-class Nanobody FW1 sequence
VDSGGGLVEAGGSLRLSCQVSE

SEQ ID NO: 36 - protein, 22 aa, Artificial Sequence
  Description of Artificial Sequence: Synthetic peptide
  KERE-class Nanobody FW1 sequence
QDSGGGSVQAGGSLKLSCAASG

SEQ ID NO: 37 - protein, 22 aa, Artificial Sequence
  Description of Artificial Sequence: Synthetic peptide
  KERE-class Nanobody FW1 sequence
VQSGGRLVQAGDSLRLSCAASE

SEQ ID NO: 38 - protein, 22 aa, Artificial Sequence
  Description of Artificial Sequence: Synthetic peptide
  KERE-class Nanobody FW1 sequence
VESGGTLVQSGDSLKLSCASST

SEQ ID NO: 39 - protein, 22 aa, Artificial Sequence
  Description of Artificial Sequence: Synthetic peptide
  KERE-class Nanobody FW1 sequence
MESGGDSVQSGGSLTLSCVASG

SEQ ID NO: 40 - protein, 22 aa, Artificial Sequence
  Description of Artificial Sequence: Synthetic peptide
  KERE-class Nanobody FW1 sequence
QASGGGLVQAGGSLRLSCSASV

SEQ ID NO: 41 - protein, 14 aa, Artificial Sequence
  Description of Artificial Sequence: Synthetic peptide
  KERE-class Nanobody FW2 sequence
WFRQAPGKEREFVA

SEQ ID NO: 42 - protein, 14 aa, Artificial Sequence
  Description of Artificial Sequence: Synthetic peptide
  KERE-class Nanobody FW2 sequence
WFRQTPGREREFVA

SEQ ID NO: 43 - protein, 14 aa, Artificial Sequence
  Description of Artificial Sequence: Synthetic peptide
  KERE-class Nanobody FW2 sequence
WYRQAPGKQREMVA

SEQ ID NO: 44 - protein, 14 aa, Artificial Sequence
  Description of Artificial Sequence: Synthetic peptide
  KERE-class Nanobody FW2 sequence
WYRQGPGKQRELVA

SEQ ID NO: 45 - protein, 14 aa, Artificial Sequence
  Description of Artificial Sequence: Synthetic peptide
  KERE-class Nanobody FW2 sequence
WIRQAPGKEREGVS

SEQ ID NO: 46 - protein, 14 aa, Artificial Sequence
  Description of Artificial Sequence: Synthetic peptide
  KERE-class Nanobody FW2 sequence
WFREAPGKEREGIS

SEQ ID NO: 47 - protein, 14 aa, Artificial Sequence
  Description of Artificial Sequence: Synthetic peptide
  KERE-class Nanobody FW2 sequence
WYRQAPGKERDLVA

SEQ ID NO: 48 - protein, 14 aa, Artificial Sequence
  Description of Artificial Sequence: Synthetic peptide
  KERE-class Nanobody FW2 sequence
WFRQAPGKQREEVS

SEQ ID NO: 49 - protein, 14 aa, Artificial Sequence
  Description of Artificial Sequence: Synthetic peptide
  KERE-class Nanobody FW2 sequence
WFRQPPGKVREFVG

SEQ ID NO: 50 - protein, 32 aa, Artificial Sequence
  Description of Artificial Sequence: Synthetic polypeptide
  KERE-class Nanobody FW3 sequence
RFTISRDNAKNTVYLQMNSLKPEDTAVYRCYF

SEQ ID NO: 51 - protein, 32 aa, Artificial Sequence
  Description of Artificial Sequence: Synthetic polypeptide
  KERE-class Nanobody FW3 sequence
RFAISRDNNKNTGYLQMNSLEPEDTAVYYCAA

SEQ ID NO: 52 - protein, 32 aa, Artificial Sequence
  Description of Artificial Sequence: Synthetic polypeptide
  KERE-class Nanobody FW3 sequence
RFTVARNNAKNTVNLEMNSLKPEDTAVYYCAA

SEQ ID NO: 53 - protein, 32 aa, Artificial Sequence
  Description of Artificial Sequence: Synthetic polypeptide
  KERE-class Nanobody FW3 sequence
RFTISRDIAKNTVDLLMNNLEPEDTAVYYCAA

SEQ ID NO: 54 - protein, 32 aa, Artificial Sequence
  Description of Artificial Sequence: Synthetic polypeptide
  KERE-class Nanobody FW3 sequence
RLTISRDNAVDTMYLQMNSLKPEDTAVYYCAA

SEQ ID NO: 55 - protein, 32 aa, Artificial Sequence
  Description of Artificial Sequence: Synthetic polypeptide
  KERE-class Nanobody FW3 sequence
RFTISRDNAKNTVYLQMDNVKPEDTAIYYCAA

SEQ ID NO: 56 - protein, 32 aa, Artificial Sequence
  Description of Artificial Sequence: Synthetic polypeptide
  KERE-class Nanobody FW3 sequence
RFTISKDSGKNTVYLQMTSLKPEDTAVYYCAT

SEQ ID NO: 57 - protein, 32 aa, Artificial Sequence
  Description of Artificial Sequence: Synthetic polypeptide
  KERE-class Nanobody FW3 sequence
RFTISRDSAKNMMYLQMNNLKPQDTAVYYCAA

SEQ ID NO: 58 - protein, 32 aa, Artificial Sequence
  Description of Artificial Sequence: Synthetic polypeptide
  KERE-class Nanobody FW3 sequence
RFTISRENDKSTVYLQLNSLKPEDTAVYYCAA

SEQ ID NO: 59 - protein, 32 aa, Artificial Sequence
  Description of Artificial Sequence: Synthetic polypeptide
  KERE-class Nanobody FW3 sequence
RFTISRDYAGNTAYLQMNSLKPEDTGVYYCAT

SEQ ID NO: 60 - protein, 11 aa, Artificial Sequence
  Description of Artificial Sequence: Synthetic peptide
  KERE-class Nanobody FW4 sequence
WGQGTQVTVSS

SEQ ID NO: 61 - protein, 11 aa, Artificial Sequence
  Description of Artificial Sequence: Synthetic peptide
  KERE-class Nanobody FW4 sequence
WGKGTLVTVSS

SEQ ID NO: 62 - protein, 11 aa, Artificial Sequence
  Description of Artificial Sequence: Synthetic peptide
  KERE-class Nanobody FW4 sequence
RGQGTRVTVSS

SEQ ID NO: 63 - protein, 11 aa, Artificial Sequence
  Description of Artificial Sequence: Synthetic peptide
  KERE-class Nanobody FW4 sequence
WGLGTQVTISS

SEQ ID NO: 64 - protein, 30 aa, Artificial Sequence
  Description of Artificial Sequence: Synthetic polypeptide
  GLEW-class Nanobody FW1 sequence
QVQLVESGGGLVQPGGSLRLSCAASGFTFS

SEQ ID NO: 65 - protein, 30 aa, Artificial Sequence
  Description of Artificial Sequence: Synthetic polypeptide
  GLEW-class Nanobody FW1 sequence
EVHLVESGGGLVRPGGSLRLSCAAFGFIFK

SEQ ID NO: 66 - protein, 30 aa, Artificial Sequence
  Description of Artificial Sequence: Synthetic polypeptide
  GLEW-class Nanobody FW1 sequence
QVKLEESGGGLAQPGGSLRLSCVASGFTFS

SEQ ID NO: 67 - protein, 30 aa, Artificial Sequence
  Description of Artificial Sequence: Synthetic polypeptide
  GLEW-class Nanobody FW1 sequence
EVQLVESGGGLVQPGGSLRLSCVCVSSGCT

SEQ ID NO: 68 - protein, 30 aa, Artificial Sequence
  Description of Artificial Sequence: Synthetic polypeptide
  GLEW-class Nanobody FW1 sequence
EVQLVESGGGLALPGGSLTLSCVFSGSTFS

SEQ ID NO: 69 - protein, 22 aa, Artificial Sequence
  Description of Artificial Sequence: Synthetic peptide
  GLEW-class Nanobody FW1 sequence
VESGGGLVQPGGSLRLSCAASG

SEQ ID NO: 70 - protein, 22 aa, Artificial Sequence
  Description of Artificial Sequence: Synthetic peptide
  GLEW-class Nanobody FW1 sequence
EESGGGLAQPGGSLRLSCVASG

SEQ ID NO: 71 - protein, 22 aa, Artificial Sequence
  Description of Artificial Sequence: Synthetic peptide
  GLEW-class Nanobody FW1 sequence
VESGGGLALPGGSLTLSCVFSG

SEQ ID NO: 72 - protein, 14 aa, Artificial Sequence
  Description of Artificial Sequence: Synthetic peptide
  GLEW-class Nanobody FW2 sequence
WVRQAPGKVLEWVS

SEQ ID NO: 73 - protein, 14 aa, Artificial Sequence
  Description of Artificial Sequence: Synthetic peptide
  GLEW-class Nanobody FW2 sequence
WVRRPPGKGLEWVS

SEQ ID NO: 74 - protein, 14 aa, Artificial Sequence
  Description of Artificial Sequence: Synthetic peptide
  GLEW-class Nanobody FW2 sequence
WVRQAPGMGLEWVS

SEQ ID NO: 75 - protein, 14 aa, Artificial Sequence
  Description of Artificial Sequence: Synthetic peptide
  GLEW-class Nanobody FW2 sequence
WVRQAPGKEPEWVS

SEQ ID NO: 76 - protein, 14 aa, Artificial Sequence
  Description of Artificial Sequence: Synthetic peptide
  GLEW-class Nanobody FW2 sequence
WVRQAPGKDQEWVS

SEQ ID NO: 77 - protein, 14 aa, Artificial Sequence
  Description of Artificial Sequence: Synthetic peptide
  GLEW-class Nanobody FW2 sequence
WVRQAPGKAEEWVS

SEQ ID NO: 78 - protein, 14 aa, Artificial Sequence
  Description of Artificial Sequence: Synthetic peptide
  GLEW-class Nanobody FW2 sequence
WVRQAPGKGLEWVA

SEQ ID NO: 79 - protein, 14 aa, Artificial Sequence
  Description of Artificial Sequence: Synthetic peptide
  GLEW-class Nanobody FW2 sequence
WVRQAPGRATEWVS

SEQ ID NO: 80 - protein, 32 aa, Artificial Sequence
  Description of Artificial Sequence: Synthetic polypeptide
  GLEW-class Nanobody FW3 sequence
RFTISRDNAKNTLYLQMNSLKPEDTAVYYCVK

SEQ ID NO: 81 - protein, 32 aa, Artificial Sequence
  Description of Artificial Sequence: Synthetic polypeptide
  GLEW-class Nanobody FW3 sequence
RFTISRDNARNTLYLQMDSLIPEDTALYYCAR

SEQ ID NO: 82 - protein, 32 aa, Artificial Sequence
  Description of Artificial Sequence: Synthetic polypeptide
  GLEW-class Nanobody FW3 sequence
RFTSSRDNAKSTLYLQMNDLKPEDTALYYCAR

SEQ ID NO: 83 - protein, 32 aa, Artificial Sequence
  Description of Artificial Sequence: Synthetic polypeptide
  GLEW-class Nanobody FW3 sequence
RFIISRDNAKNTLYLQMNSLGPEDTAMYYCQR

SEQ ID NO: 84 - protein, 32 aa, Artificial Sequence
  Description of Artificial Sequence: Synthetic polypeptide
  GLEW-class Nanobody FW3 sequence
RFTASRDNAKNTLYLQMNSLKSEDTARYYCAR

SEQ ID NO: 85 - protein, 32 aa, Artificial Sequence
  Description of Artificial Sequence: Synthetic polypeptide
  GLEW-class Nanobody FW3 sequence
RFTISRDNAKNTLYLQMDDLQSEDTAMYYCGR

SEQ ID NO: 86 - protein, 11 aa, Artificial Sequence
  Description of Artificial Sequence: Synthetic peptide
  GLEW-class Nanobody FW4 sequence
GSQGTQVTVSS

SEQ ID NO: 87 - protein, 11 aa, Artificial Sequence
  Description of Artificial Sequence: Synthetic peptide
  GLEW-class Nanobody FW4 sequence
LRGGTQVTVSS

SEQ ID NO: 88 - protein, 11 aa, Artificial Sequence
  Description of Artificial Sequence: Synthetic peptide
  GLEW-class Nanobody FW4 sequence
RGQGTLVTVSS

SEQ ID NO: 89 - protein, 11 aa, Artificial Sequence
  Description of Artificial Sequence: Synthetic peptide
  GLEW-class Nanobody FW4 sequence
RSRGIQVTVSS

SEQ ID NO: 90 - protein, 11 aa, Artificial Sequence
  Description of Artificial Sequence: Synthetic peptide
  GLEW-class Nanobody FW4 sequence
WGKGTQVTVSS

SEQ ID NO: 91 - protein, 11 aa, Artificial Sequence
  Description of Artificial Sequence: Synthetic peptide
  GLEW-class Nanobody FW4 sequence
WGQGTQVTVSS

SEQ ID NO: 92 - protein, 30 aa, Artificial Sequence
  Description of Artificial Sequence: Synthetic polypeptide
  P,R,S 103-class Nanobody FW1 sequence
AVQLVESGGGLVQAGGSLRLSCAASGRTFS

SEQ ID NO: 93 - protein, 30 aa, Artificial Sequence
  Description of Artificial Sequence: Synthetic polypeptide
  P,R,S 103-class Nanobody FW1 sequence
QVQLQESGGGMVQPGGSLRLSCAASGFDFG

SEQ ID NO: 94 - protein, 30 aa, Artificial Sequence; identical to SEQ ID NO: 65
  Description of Artificial Sequence: Synthetic polypeptide
  P,R,S 103-class Nanobody FW1 sequence

SEQ ID NO: 95 - protein, 30 aa, Artificial Sequence
  Description of Artificial Sequence: Synthetic polypeptide
  P,R,S 103-class Nanobody FW1 sequence
QVQLAESGGGLVQPGGSLKLSCAASRTIVS

SEQ ID NO: 96 - protein, 30 aa, Artificial Sequence
  Description of Artificial Sequence: Synthetic polypeptide
  P,R,S 103-class Nanobody FW1 sequence
QEHLVESGGGLVDIGGSLRLSCAASERIFS

SEQ ID NO: 97 - protein, 30 aa, Artificial Sequence; identical to SEQ ID NO: 66
  Description of Artificial Sequence: Synthetic polypeptide
  P,R,S 103-class Nanobody FW1 sequence

SEQ ID NO: 98 - protein, 30 aa, Artificial Sequence; identical to SEQ ID NO: 67
  Description of Artificial Sequence: Synthetic polypeptide
  P,R,S 103-class Nanobody FW1 sequence

SEQ ID NO: 99 - protein, 30 aa, Artificial Sequence; identical to SEQ ID NO: 68
  Description of Artificial Sequence: Synthetic polypeptide
  P,R,S 103-class Nanobody FW1 sequence

SEQ ID NO: 100 - protein, 22 aa, Artificial Sequence
  Description of Artificial Sequence: Synthetic peptide
  P,R,S 103-class Nanobody FW1 sequence
VESGGGLVQAGGSLRLSCAASG

SEQ ID NO: 101 - protein, 22 aa, Artificial Sequence
  Description of Artificial Sequence: Synthetic peptide
  P,R,S 103-class Nanobody FW1 sequence
AESGGGLVQPGGSLKLSCAASR

SEQ ID NO: 102 - protein, 14 aa, Artificial Sequence
  Description of Artificial Sequence: Synthetic peptide
  P,R,S 103-class Nanobody FW2 sequence
WFRQAPGKEREFVA

SEQ ID NO: 103 - protein, 14 aa, Artificial Sequence
  Description of Artificial Sequence: Synthetic peptide
  P,R,S 103-class Nanobody FW2 sequence
WVRQAPGKVLEWVS

SEQ ID NO: 104 - protein, 14 aa, Artificial Sequence
  Description of Artificial Sequence: Synthetic peptide
  P,R,S 103-class Nanobody FW2 sequence
WVRRPPGKGLEWVS

SEQ ID NO: 105 - protein, 14 aa, Artificial Sequence
  Description of Artificial Sequence: Synthetic peptide
  P,R,S 103-class Nanobody FW2 sequence
WIRQAPGKEREGVS

SEQ ID NO: 106 - protein, 14 aa, Artificial Sequence
  Description of Artificial Sequence: Synthetic peptide
  P,R,S 103-class Nanobody FW2 sequence
WVRQYPGKEPEWVS

SEQ ID NO: 107 - protein, 14 aa, Artificial Sequence
  Description of Artificial Sequence: Synthetic peptide
  P,R,S 103-class Nanobody FW2 sequence
WFRQPPGKEHEFVA

SEQ ID NO: 108 - protein, 14 aa, Artificial Sequence
  Description of Artificial Sequence: Synthetic peptide
  P,R,S 103-class Nanobody FW2 sequence
WYRQAPGKRTELVA

SEQ ID NO: 109 - protein, 14 aa, Artificial Sequence
  Description of Artificial Sequence: Synthetic peptide
  P,R,S 103-class Nanobody FW2 sequence
WLRQAPGQGLEWVS

SEQ ID NO: 110 - protein, 14 aa, Artificial Sequence
  Description of Artificial Sequence: Synthetic peptide
  P,R,S 103-class Nanobody FW2 sequence
WLRQTPGKGLEWVG

SEQ ID NO: 111 - protein, 14 aa, Artificial Sequence
  Description of Artificial Sequence: Synthetic peptide
  P,R,S 103-class Nanobody FW2 sequence
WVRQAPGKAEEFVS

SEQ ID NO: 112 - protein, 32 aa, Artificial Sequence
  Description of Artificial Sequence: Synthetic polypeptide
  P,R,S 103-class Nanobody FW3 sequence
RFTISRDNAKNTVYLQMNSLKPEDTAVYYCAA

SEQ ID NO: 113 - protein, 32 aa, Artificial Sequence; identical to SEQ ID NO: 81
  Description of Artificial Sequence: Synthetic polypeptide
  P,R,S 103-class Nanobody FW3 sequence

SEQ ID NO: 114 - protein, 32 aa, Artificial Sequence
  Description of Artificial Sequence: Synthetic polypeptide
  P,R,S 103-class Nanobody FW3 sequence
RFTISRDNAKNEMYLQMNNLKTEDTGVYWCGA

SEQ ID NO: 115 - protein, 32 aa, Artificial Sequence
  Description of Artificial Sequence: Synthetic polypeptide
  P,R,S 103-class Nanobody FW3 sequence
RFTISSDSNRNMIYLQMNNLKPEDTAVYYCAA

SEQ ID NO: 116 - protein, 32 aa, Artificial Sequence
  Description of Artificial Sequence: Synthetic polypeptide
  P,R,S 103-class Nanobody FW3 sequence
RFTISRDNAKNMLYLHLNNLKSEDTAVYYCRR

SEQ ID NO: 117 - protein, 32 aa, Artificial Sequence
  Description of Artificial Sequence: Synthetic polypeptide
  P,R,S 103-class Nanobody FW3 sequence
RFTISRDNAKKTVYLRLNSLNPEDTAVYSCNL

SEQ ID NO: 118 - protein, 32 aa, Artificial Sequence
  Description of Artificial Sequence: Synthetic polypeptide
  P,R,S 103-class Nanobody FW3 sequence
RFKISRDNAKKTLYLQMNSLGPEDTAMYYCQR

SEQ ID NO: 119 - protein, 32 aa, Artificial Sequence
  Description of Artificial Sequence: Synthetic polypeptide
  P,R,S 103-class Nanobody FW3 sequence
RFTVSRDNGKNTAYLRMNSLKPEDTADYYCAV

SEQ ID NO: 120 - protein, 11 aa, Artificial Sequence
  Description of Artificial Sequence: Synthetic peptide
  P,R,S 103-class Nanobody FW4 sequence
RGQGTQVTVSS

SEQ ID NO: 121 - protein, 11 aa, Artificial Sequence
  Description of Artificial Sequence: Synthetic peptide
  P,R,S 103-class Nanobody FW4 sequence
LRGGTQVTVSS

SEQ ID NO: 122 - protein, 11 aa, Artificial Sequence
  Description of Artificial Sequence: Synthetic peptide
  P,R,S 103-class Nanobody FW4 sequence
GNKGTLVTVSS

SEQ ID NO: 123 - protein, 11 aa, Artificial Sequence
  Description of Artificial Sequence: Synthetic peptide
  P,R,S 103-class Nanobody FW4 sequence
SSPGTQVTVSS

SEQ ID NO: 124 - protein, 11 aa, Artificial Sequence
  Description of Artificial Sequence: Synthetic peptide
  P,R,S 103-class Nanobody FW4 sequence
SSQGTLVTVSS

SEQ ID NO: 125 - protein, 11 aa, Artificial Sequence
  Description of Artificial Sequence: Synthetic peptide
  P,R,S 103-class Nanobody FW4 sequence
RSRGIQVTVSS

SEQ ID NO: 126 - protein, 30 aa, Artificial Sequence
  Description of Artificial Sequence: Synthetic polypeptide
  Nanobody sequence
EVQLVESGGGLVQAGGSLRLSCAASGLSFS

SEQ ID NO: 127 - protein, 30 aa, Artificial Sequence
  Description of Artificial Sequence: Synthetic polypeptide
  Nanobody sequence
EVQLVESGGGLVQAGGSLRLSCAASERTIS

SEQ ID NO: 128 - protein, 30 aa, Artificial Sequence
  Description of Artificial Sequence: Synthetic polypeptide
  Nanobody sequence
EVQLVESGGGLVQPGGSLRLSCAASGFTFS

SEQ ID NO: 129 - protein, 30 aa, Artificial Sequence
  Description of Artificial Sequence: Synthetic polypeptide
  Nanobody sequence
EVQLVESGGGLVQAGGSLRLSCAASGFTFD

SEQ ID NO: 130 - protein, 30 aa, Artificial Sequence
  Description of Artificial Sequence: Synthetic polypeptide
  Nanobody sequence
EVQLVESGGGLVQAGGSLRLSCAASGVTFD

SEQ ID NO: 131 - protein, 30 aa, Artificial Sequence
  Description of Artificial Sequence: Synthetic polypeptide
  Nanobody sequence
EVQLVESGGGLVQAGGSLRLSCAADGRTFS

SEQ ID NO: 132 - protein, 30 aa, Artificial Sequence
  Description of Artificial Sequence: Synthetic polypeptide
  Nanobody sequence
EVQLVESGGGVVQPGGSLRLSCADSERSFS

SEQ ID NO: 133 - protein, 30 aa, Artificial Sequence
  Description of Artificial Sequence: Synthetic polypeptide
  Nanobody sequence
EVQLVESGGGLVQPGGSLRLSCAASGFALG

SEQ ID NO: 134 - protein, 30 aa, Artificial Sequence
  Description of Artificial Sequence: Synthetic polypeptide
  Nanobody sequence
EVQLVESGGGLVQPGGSLRLSCAASGFTLG

SEQ ID NO: 135 - protein, 30 aa, Artificial Sequence; identical to SEQ ID NO: 129
  Description of Artificial Sequence: Synthetic polypeptide
  Nanobody sequence

SEQ ID NO: 136 - protein, 30 aa, Artificial Sequence
  Description of Artificial Sequence: Synthetic polypeptide
  Nanobody sequence
EVQLVESGGGLVQPGGSLRLSCAASRNINI

SEQ ID NO: 137 - protein, 30 aa, Artificial Sequence
  Description of Artificial Sequence: Synthetic polypeptide
  Nanobody sequence
EVQLVESGGGLVQAGGSQSLSCVASGTIVN

SEQ ID NO: 138 - protein, 30 aa, Artificial Sequence
  Description of Artificial Sequence: Synthetic polypeptide
  Nanobody sequence
EVQLVESGGGLVQAGGSQRLSCTASGTIVN

SEQ ID NO: 139 - protein, 30 aa, Artificial Sequence
  Description of Artificial Sequence: Synthetic polypeptide
  Nanobody sequence
EVQLVESGGGLVQPGGSLRLSCAASGRTFS

SEQ ID NO: 140 - protein, 30 aa, Artificial Sequence
  Description of Artificial Sequence: Synthetic polypeptide
  Nanobody sequence
EVQLVESGGGLVQAGGSLSLSCAASGSVFR

SEQ ID NO: 141 - protein, 30 aa, Artificial Sequence
  Description of Artificial Sequence: Synthetic polypeptide
  Nanobody sequence
EVQLVESGGGLVQAGGSLRLSCAASDSVFT

SEQ ID NO: 142 - protein, 30 aa, Artificial Sequence
  Description of Artificial Sequence: Synthetic polypeptide
  Nanobody sequence
EVQLVESGGGLVQPGESLRLSCKASGFSLD

SEQ ID NO: 143 - protein, 30 aa, Artificial Sequence
  Description of Artificial Sequence: Synthetic polypeptide
  Nanobody sequence
EVQLVESGGGLVQAGGSLRLSCPVSGRAFS

SEQ ID NO: 144 - protein, 30 aa, Artificial Sequence
  Description of Artificial Sequence: Synthetic polypeptide
  Nanobody sequence
EVQLVESGGGLVQAGGSLRLSCGASGGTFS

SEQ ID NO: 145 - protein, 30 aa, Artificial Sequence
  Description of Artificial Sequence: Synthetic polypeptide
  Nanobody sequence
EVQLVESGGGLVQAGGSLRLSCGAAGGTFS

SEQ ID NO: 146 - protein, 30 aa, Artificial Sequence
  Description of Artificial Sequence: Synthetic polypeptide
  Nanobody sequence
EVQLVESGGGLVQAGGSLRLSCVASGRAFS

SEQ ID NO: 147 - protein, 30 aa, Artificial Sequence
  Description of Artificial Sequence: Synthetic polypeptide
  Nanobody sequence
EVQLVESGGGLVQAGGSLRLSCAASGRTFR

SEQ ID NO: 148 - protein, 30 aa, Artificial Sequence
  Description of Artificial Sequence: Synthetic polypeptide
  Nanobody sequence
EVQLVESGGGLVQPGGSLRLSCAASGRDFR

SEQ ID NO: 149 - protein, 30 aa, Artificial Sequence; identical to SEQ ID NO: 144
  Description of Artificial Sequence: Synthetic polypeptide
  Nanobody sequence

SEQ ID NO: 150 - protein, 30 aa, Artificial Sequence; identical to SEQ ID NO: 128
  Description of Artificial Sequence: Synthetic polypeptide
  Nanobody sequence

SEQ ID NO: 151 - protein, 30 aa, Artificial Sequence
  Description of Artificial Sequence: Synthetic polypeptide
  Nanobody sequence
EVQLVESGGGLVQAGGSLRLSCAASGRTFS

SEQ ID NO: 152 - protein, 30 aa, Artificial Sequence
  Description of Artificial Sequence: Synthetic polypeptide
  Nanobody sequence
EVQLVESGGGLVQAGGSLRLSCAVSGGTFS

SEQ ID NO: 153 - protein, 30 aa, Artificial Sequence; identical to SEQ ID NO: 129
  Description of Artificial Sequence: Synthetic polypeptide
  Nanobody sequence

SEQ ID NO: 154 - protein, 30 aa, Artificial Sequence
  Description of Artificial Sequence: Synthetic polypeptide
  Nanobody sequence
EMQLVESGGGLVQPGGSLRLSCAASGFTFS

SEQ ID NO: 155 - protein, 30 aa, Artificial Sequence; identical to SEQ ID NO: 128
  Description of Artificial Sequence: Synthetic polypeptide
  Nanobody sequence

SEQ ID NO: 156 - protein, 30 aa, Artificial Sequence; identical to SEQ ID NO: 128
  Description of Artificial Sequence: Synthetic polypeptide
  Nanobody sequence

SEQ ID NO: 157 - protein, 30 aa, Artificial Sequence; identical to SEQ ID NO: 128
  Description of Artificial Sequence: Synthetic polypeptide
  Nanobody sequence

SEQ ID NO: 158 - protein, 30 aa, Artificial Sequence
  Description of Artificial Sequence: Synthetic polypeptide
  Nanobody sequence
EVQLVESGGGLVQAGGSLRLSCAASGFTFS

SEQ ID NO: 159 - protein, 30 aa, Artificial Sequence; identical to SEQ ID NO: 128
  Description of Artificial Sequence: Synthetic polypeptide
  Nanobody sequence

SEQ ID NO: 160 - protein, 30 aa, Artificial Sequence
  Description of Artificial Sequence: Synthetic polypeptide
  Nanobody sequence
EVQLVESGGGLVQAGGSLRLSCAASGVIFR

SEQ ID NO: 161 - protein, 30 aa, Artificial Sequence
  Description of Artificial Sequence: Synthetic polypeptide
  Nanobody sequence
EVQLVESGGGLVQAGGSLRLSCAAPGVIFR

SEQ ID NO: 162 - protein, 30 aa, Artificial Sequence; identical to SEQ ID NO: 160
  Description of Artificial Sequence: Synthetic polypeptide
  Nanobody sequence

SEQ ID NO: 163 - protein, 30 aa, Artificial Sequence; identical to SEQ ID NO: 160
  Description of Artificial Sequence: Synthetic polypeptide
  Nanobody sequence

SEQ ID NO: 164 - protein, 30 aa, Artificial Sequence
  Description of Artificial Sequence: Synthetic polypeptide
  Nanobody sequence
EVQLVESGGGLVQPGGSLRLSCAASGVIFR

SEQ ID NO: 165 - protein, 30 aa, Artificial Sequence
  Description of Artificial Sequence: Synthetic polypeptide
  Nanobody sequence
EVQLVESGGGSVQAGDSLRLSCAASGRANS

SEQ ID NO: 166 - protein, 30 aa, Artificial Sequence; identical to SEQ ID NO: 165
  Description of Artificial Sequence: Synthetic polypeptide
  Nanobody sequence

SEQ ID NO: 167 - protein, 30 aa, Artificial Sequence
  Description of Artificial Sequence: Synthetic polypeptide
  Nanobody sequence
EVQLVESGGGLVQAGGSLRLSCAASGRTYD

SEQ ID NO: 168 - protein, 30 aa, Artificial Sequence
  Description of Artificial Sequence: Synthetic polypeptide
  Nanobody sequence
EVQLVESGGGLVQAGGSLRLSCAASGRTYY

SEQ ID NO: 169 - protein, 30 aa, Artificial Sequence; identical to SEQ ID NO: 168
  Description of Artificial Sequence: Synthetic polypeptide
  Nanobody sequence

SEQ ID NO: 170 - protein, 30 aa, Artificial Sequence
  Description of Artificial Sequence: Synthetic polypeptide
  Nanobody sequence
EVQLVESGGGLVQAGGSLRLSCAASGRTYH

SEQ ID NO: 171 - protein, 30 aa, Artificial Sequence; identical to SEQ ID NO: 167
  Description of Artificial Sequence: Synthetic polypeptide
  Nanobody sequence

SEQ ID NO: 172 - protein, 30 aa, Artificial Sequence
  Description of Artificial Sequence: Synthetic polypeptide
  Nanobody sequence
EVQLVESGGGKVQAGDSLTLSCVASGGTFS

SEQ ID NO: 173 - protein, 30 aa, Artificial Sequence
  Description of Artificial Sequence: Synthetic polypeptide
  Nanobody sequence
EVQLVESGGGLVQAGGSLRLSCEASGGTFS

SEQ ID NO: 174 - protein, 30 aa, Artificial Sequence
  Description of Artificial Sequence: Synthetic polypeptide
  Nanobody sequence
EVQLVESGGGLVQAGDSLTLSCVASGGTFS

SEQ ID NO: 175 - protein, 30 aa, Artificial Sequence
  Description of Artificial Sequence: Synthetic polypeptide
  Nanobody sequence
EVQLVESGGGLVQAGDSLRLSCEASGGTFS

SEQ ID NO: 176 - protein, 30 aa, Artificial Sequence
  Description of Artificial Sequence: Synthetic polypeptide
  Nanobody sequence
EVQLVESGGGLVQPGGSLRLSCEASGGTFS

SEQ ID NO: 177 - protein, 30 aa, Artificial Sequence
  Description of Artificial Sequence: Synthetic polypeptide
  Nanobody sequence
EVQLVESGGGLVQAGDSLRLSCVASGGTFS

SEQ ID NO: 178 - protein, 30 aa, Artificial Sequence; identical to SEQ ID NO: 174
  Description of Artificial Sequence: Synthetic polypeptide
  Nanobody sequence

SEQ ID NO: 179 - protein, 30 aa, Artificial Sequence
  Description of Artificial Sequence: Synthetic polypeptide
  Nanobody sequence
EVQLVKSGGGLVQAGGSLKLSCAASGRTFT

SEQ ID NO: 180 - protein, 30 aa, Artificial Sequence
  Description of Artificial Sequence: Synthetic polypeptide
  Nanobody sequence
EVQLVESGGGLVQAGGSLRLSCAASGRTFT

SEQ ID NO: 181 - protein, 30 aa, Artificial Sequence
  Description of Artificial Sequence: Synthetic polypeptide
  Nanobody sequence
EVQLVESGGGLVQAGGSLKLSCARSGRTFT

SEQ ID NO: 182 - protein, 30 aa, Artificial Sequence
  Description of Artificial Sequence: Synthetic polypeptide
  Nanobody sequence
EVQLVESRGRLVQAGGSLRLSCAASGRTFT

SEQ ID NO: 183 - protein, 30 aa, Artificial Sequence
  Description of Artificial Sequence: Synthetic polypeptide
  Nanobody sequence
EVQLVESGGRLVQAGGSLRLSCAASGRTFT

SEQ ID NO: 184 - protein, 30 aa, Artificial Sequence; identical to SEQ ID NO: 183
  Description of Artificial Sequence: Synthetic polypeptide
  Nanobody sequence

SEQ ID NO: 185 - protein, 30 aa, Artificial Sequence
  Description of Artificial Sequence: Synthetic polypeptide
  Nanobody sequence
EVQLVESEGGLVQAGGSLRLSCARSGHAFT

SEQ ID NO: 186 - protein, 30 aa, Artificial Sequence; identical to SEQ ID NO: 180
  Description of Artificial Sequence: Synthetic polypeptide
  Nanobody sequence

SEQ ID NO: 187 - protein, 30 aa, Artificial Sequence
  Description of Artificial Sequence: Synthetic polypeptide
  Nanobody sequence
EVQLVESRGGLVQAGGSLRLSCAGSGRTLY

SEQ ID NO: 188 - protein, 30 aa, Artificial Sequence
  Description of Artificial Sequence: Synthetic polypeptide
  Nanobody sequence
EVQLVESGGGLVQAGGSLRLSCAASGRTLY

SEQ ID NO: 189 - protein, 30 aa, Artificial Sequence
  Description of Artificial Sequence: Synthetic polypeptide
  Nanobody sequence
EVQLVESGGGLVQAGGSLELSCARSGRTFT

SEQ ID NO: 190 - protein, 30 aa, Artificial Sequence
  Description of Artificial Sequence: Synthetic polypeptide
  Nanobody sequence
EVQLVESGGGLVQAGGSLRLSCAASGRTFF

SEQ ID NO: 191 - protein, 30 aa, Artificial Sequence; identical to SEQ ID NO: 180
  Description of Artificial Sequence: Synthetic polypeptide
  Nanobody sequence

SEQ ID NO: 192 - protein, 30 aa, Artificial Sequence
  Description of Artificial Sequence: Synthetic polypeptide
  Nanobody sequence
EVQLVESGGRLVQAGGSLRLPCAASGRTFT

SEQ ID NO: 193 - protein, 30 aa, Artificial Sequence
  Description of Artificial Sequence: Synthetic polypeptide
  Nanobody sequence
EVQLVESGGGLVQPGGSLRLSCAASGFTLD

SEQ ID NO: 194 - protein, 30 aa, Artificial Sequence
  Description of Artificial Sequence: Synthetic polypeptide
  Nanobody sequence
EVQLVESRGGLVQAGGSLRLSCAASGGTFS

SEQ ID NO: 195 - protein, 30 aa, Artificial Sequence; identical to SEQ ID NO: 194
  Description of Artificial Sequence: Synthetic polypeptide
  Nanobody sequence

SEQ ID NO: 196 - protein, 30 aa, Artificial Sequence
  Description of Artificial Sequence: Synthetic polypeptide
  Nanobody sequence
EVQLVKSGGGLVQPGGSLRLSCAASGGTFS

SEQ ID NO: 197 - protein, 5 aa, Artificial Sequence
  Description of Artificial Sequence: Synthetic peptide
  Nanobody sequence
SYALG

SEQ ID NO: 198 - protein, 5 aa, Artificial Sequence
  Description of Artificial Sequence: Synthetic peptide
  Nanobody sequence
NYDMG

SEQ ID NO: 199 - protein, 5 aa, Artificial Sequence
  Description of Artificial Sequence: Synthetic peptide
  Nanobody sequence
SYAMS

SEQ ID NO: 200 - protein, 5 aa, Artificial Sequence
  Description of Artificial Sequence: Synthetic peptide
  Nanobody sequence
DYAIG

SEQ ID NO: 201 - protein, 5 aa, Artificial Sequence
  Description of Artificial Sequence: Synthetic peptide
  Nanobody sequence
DYSIG

SEQ ID NO: 202 - protein, 5 aa, Artificial Sequence
  Description of Artificial Sequence: Synthetic peptide
  Nanobody sequence
TYGMT

SEQ ID NO: 203 - protein, 5 aa, Artificial Sequence
  Description of Artificial Sequence: Synthetic peptide
  Nanobody sequence
FNAMG

SEQ ID NO: 204 - protein, 5 aa, Artificial Sequence
  Description of Artificial Sequence: Synthetic peptide
  Nanobody sequence
YYAIG

SEQ ID NO: 205 - protein, 5 aa, Artificial Sequence
  Description of Artificial Sequence: Synthetic peptide
  Nanobody sequence
YYAIG

SEQ ID NO: 206 - protein, 5 aa, Artificial Sequence
  Description of Artificial Sequence: Synthetic peptide
  Nanobody sequence
DYAIG

SEQ ID NO: 207 - protein, 5 aa, Artificial Sequence
  Description of Artificial Sequence: Synthetic peptide
  Nanobody sequence
INYMA

SEQ ID NO: 208 - protein, 5 aa, Artificial Sequence
  Description of Artificial Sequence: Synthetic peptide
  Nanobody sequence
INVMG

SEQ ID NO: 209 - protein, 5 aa, Artificial Sequence
  Description of Artificial Sequence: Synthetic peptide
  Nanobody sequence
IHVMG

SEQ ID NO: 210 - protein, 5 aa, Artificial Sequence
  Description of Artificial Sequence: Synthetic peptide
  Nanobody sequence
THAMG

SEQ ID NO: 211 - protein, 5 aa, Artificial Sequence
  Description of Artificial Sequence: Synthetic peptide
  Nanobody sequence
IDVMR

SEQ ID NO: 212 - protein, 5 aa, Artificial Sequence
  Description of Artificial Sequence: Synthetic peptide
  Nanobody sequence
AKAVG

SEQ ID NO: 213 - protein, 5 aa, Artificial Sequence
  Description of Artificial Sequence: Synthetic peptide
  Nanobody sequence
YYALG

SEQ ID NO: 214 - protein, 5 aa, Artificial Sequence
  Description of Artificial Sequence: Synthetic peptide
  Nanobody sequence
RGRLG

SEQ ID NO: 215 - protein, 5 aa, Artificial Sequence
  Description of Artificial Sequence: Synthetic peptide
  Nanobody sequence
SYATG

SEQ ID NO: 216 - protein, 5 aa, Artificial Sequence
  Description of Artificial Sequence: Synthetic peptide
  Nanobody sequence
SYATG

SEQ ID NO: 217 - protein, 5 aa, Artificial Sequence
  Description of Artificial Sequence: Synthetic peptide
  Nanobody sequence
SYVMG

SEQ ID NO: 218 - protein, 5 aa, Artificial Sequence
  Description of Artificial Sequence: Synthetic peptide
  Nanobody sequence
PYRMG

SEQ ID NO: 219 - protein, 5 aa, Artificial Sequence
  Description of Artificial Sequence: Synthetic peptide
  Nanobody sequence
VKNVG

SEQ ID NO: 220 - protein, 5 aa, Artificial Sequence
  Description of Artificial Sequence: Synthetic peptide
  Nanobody sequence
SYATG

SEQ ID NO: 221 - protein, 5 aa, Artificial Sequence
  Description of Artificial Sequence: Synthetic peptide
  Nanobody sequence
SYRMA

SEQ ID NO: 222 - protein, 5 aa, Artificial Sequence
  Description of Artificial Sequence: Synthetic peptide
  Nanobody sequence
SYVVG

SEQ ID NO: 223 - protein, 5 aa, Artificial Sequence
  Description of Artificial Sequence: Synthetic peptide
  Nanobody sequence
TYKMG

SEQ ID NO: 224 - protein, 5 aa, Artificial Sequence
  Description of Artificial Sequence: Synthetic peptide
  Nanobody sequence
DYDIG

SEQ ID NO: 225 - protein, 5 aa, Artificial Sequence
  Description of Artificial Sequence: Synthetic peptide
  Nanobody sequence
SYWMY

SEQ ID NO: 226 - protein, 5 aa, Artificial Sequence
  Description of Artificial Sequence: Synthetic peptide
  Nanobody sequence
SYWMY

SEQ ID NO: 227 - protein, 5 aa, Artificial Sequence
  Description of Artificial Sequence: Synthetic peptide
  Nanobody sequence
SYWMY

SEQ ID NO: 228 - protein, 5 aa, Artificial Sequence
  Description of Artificial Sequence: Synthetic peptide
  Nanobody sequence
NYWMY

SEQ ID NO: 229 - protein, 5 aa, Artificial Sequence
  Description of Artificial Sequence: Synthetic peptide
  Nanobody sequence
SYWMY

SEQ ID NO: 230 - protein, 5 aa, Artificial Sequence
  Description of Artificial Sequence: Synthetic peptide
  Nanobody sequence
SYWMY

SEQ ID NO: 231 - protein, 5 aa, Artificial Sequence
  Description of Artificial Sequence: Synthetic peptide
  Nanobody sequence
LNAMG

SEQ ID NO: 232 - protein, 5 aa, Artificial Sequence
  Description of Artificial Sequence: Synthetic peptide
  Nanobody sequence
LNAMG

SEQ ID NO: 233 - protein, 5 aa, Artificial Sequence
  Description of Artificial Sequence: Synthetic peptide
  Nanobody sequence
LNAMG

SEQ ID NO: 234 - protein, 5 aa, Artificial Sequence
  Description of Artificial Sequence: Synthetic peptide
  Nanobody sequence
LNAMG

SEQ ID NO: 235 - protein, 5 aa, Artificial Sequence
  Description of Artificial Sequence: Synthetic peptide
  Nanobody sequence
LNAMG

SEQ ID NO: 236 - protein, 5 aa, Artificial Sequence
  Description of Artificial Sequence: Synthetic peptide
  Nanobody sequence
INWFG

SEQ ID NO: 237 - protein, 5 aa, Artificial Sequence
  Description of Artificial Sequence: Synthetic peptide
  Nanobody sequence
INWFG

SEQ ID NO: 238 - protein, 3 aa, Artificial Sequence
  Description of Artificial Sequence: Synthetic peptide
  Nanobody sequence
AMG

SEQ ID NO: 239 - protein, 3 aa, Artificial Sequence
  Description of Artificial Sequence: Synthetic peptide
  Nanobody sequence
AMG

SEQ ID NO: 240 - protein, 3 aa, Artificial Sequence
  Description of Artificial Sequence: Synthetic peptide
  Nanobody sequence
AMG

SEQ ID NO: 241 - protein, 3 aa, Artificial Sequence
  Description of Artificial Sequence: Synthetic peptide
  Nanobody sequence
AMG

SEQ ID NO: 242 - protein, 3 aa, Artificial Sequence
  Description of Artificial Sequence: Synthetic peptide
  Nanobody sequence
AMG

SEQ ID NO: 243 - protein, 4 aa, Artificial Sequence
  Description of Artificial Sequence: Synthetic peptide
  Nanobody sequence
NYAA

SEQ ID NO: 244 - protein, 4 aa, Artificial Sequence
  Description of Artificial Sequence: Synthetic peptide
  Nanobody sequence
NYAA

SEQ ID NO: 245 - protein, 4 aa, Artificial Sequence
  Description of Artificial Sequence: Synthetic peptide
  Nanobody sequence
NYAA

SEQ ID NO: 246 - protein, 4 aa, Artificial Sequence
  Description of Artificial Sequence: Synthetic peptide
  Nanobody sequence
NYAA

SEQ ID NO: 247 - protein, 4 aa, Artificial Sequence
  Description of Artificial Sequence: Synthetic peptide
  Nanobody sequence
NYAA

SEQ ID NO: 248 - protein, 4 aa, Artificial Sequence
  Description of Artificial Sequence: Synthetic peptide
  Nanobody sequence
NYAA

SEQ ID NO: 249 - protein, 4 aa, Artificial Sequence
  Description of Artificial Sequence: Synthetic peptide
  Nanobody sequence
NYAA

SEQ ID NO: 250 - protein, 5 aa, Artificial Sequence
  Description of Artificial Sequence: Synthetic peptide
  Nanobody sequence
TYPMG

SEQ ID NO: 251 - protein, 5 aa, Artificial Sequence
  Description of Artificial Sequence: Synthetic peptide
  Nanobody sequence
TYPMG

SEQ ID NO: 252 - protein, 5 aa, Artificial Sequence
  Description of Artificial Sequence: Synthetic peptide
  Nanobody sequence
TYPMG

SEQ ID NO: 253 - protein, 5 aa, Artificial Sequence
  Description of Artificial Sequence: Synthetic peptide
  Nanobody sequence
SYPMG

SEQ ID NO: 254 - protein, 5 aa, Artificial Sequence
  Description of Artificial Sequence: Synthetic peptide
  Nanobody sequence
SYPMG

SEQ ID NO: 255 - protein, 5 aa, Artificial Sequence
  Description of Artificial Sequence: Synthetic peptide
  Nanobody sequence
SYPMG

SEQ ID NO: 256 - protein, 5 aa, Artificial Sequence
  Description of Artificial Sequence: Synthetic peptide
  Nanobody sequence
SYPMG

SEQ ID NO: 257 - protein, 5 aa, Artificial Sequence
  Description of Artificial Sequence: Synthetic peptide
  Nanobody sequence
TYPMG

SEQ ID NO: 258 - protein, 5 aa, Artificial Sequence
  Description of Artificial Sequence: Synthetic peptide
  Nanobody sequence
SYPMG

SEQ ID NO: 259 - protein, 5 aa, Artificial Sequence
  Description of Artificial Sequence: Synthetic peptide
  Nanobody sequence
SYPMG

SEQ ID NO: 260 - protein, 5 aa, Artificial Sequence
  Description of Artificial Sequence: Synthetic peptide
  Nanobody sequence
TYPMG

SEQ ID NO: 261 - protein, 5 aa, Artificial Sequence
  Description of Artificial Sequence: Synthetic peptide
  Nanobody sequence
SYPMG

SEQ ID NO: 262 - protein, 5 aa, Artificial Sequence
  Description of Artificial Sequence: Synthetic peptide
  Nanobody sequence
TYPMG

SEQ ID NO: 263 - protein, 5 aa, Artificial Sequence
  Description of Artificial Sequence: Synthetic peptide
  Nanobody sequence
SYPMG

SEQ ID NO: 264 - protein, 5 aa, Artificial Sequence
  Description of Artificial Sequence: Synthetic peptide
  Nanobody sequence
YYAIG

SEQ ID NO: 265 - protein, 5 aa, Artificial Sequence
  Description of Artificial Sequence: Synthetic peptide
  Nanobody sequence
VFAMR

SEQ ID NO: 266 - protein, 5 aa, Artificial Sequence
  Description of Artificial Sequence: Synthetic peptide
  Nanobody sequence
VFAMR

SEQ ID NO: 267 - protein, 5 aa, Artificial Sequence
  Description of Artificial Sequence: Synthetic peptide
  Nanobody sequence
LFAMG

SEQ ID NO: 268 - protein, 14 aa, Artificial Sequence
  Description of Artificial Sequence: Synthetic peptide
  Nanobody sequence
WFRQAPGKERDFVA

SEQ ID NO: 269 - protein, 14 aa, Artificial Sequence
  Description of Artificial Sequence: Synthetic peptide
  Nanobody sequence
WFRQAPGKERELIA

SEQ ID NO: 270 - protein, 14 aa, Artificial Sequence
  Description of Artificial Sequence: Synthetic peptide
  Nanobody sequence
WARQAPGEGLEWVS

SEQ ID NO: 271 - protein, 14 aa, Artificial Sequence
  Description of Artificial Sequence: Synthetic peptide
  Nanobody sequence
WFRQAPGKEREGVS

SEQ ID NO: 272 - protein, 14 aa, Artificial Sequence
  Description of Artificial Sequence: Synthetic peptide
  Nanobody sequence
WFRQAPGKEREGVS

SEQ ID NO: 273 - protein, 14 aa, Artificial Sequence
  Description of Artificial Sequence: Synthetic peptide
  Nanobody sequence
WFRQVPGKEREFVA

SEQ ID NO: 274 - protein, 14 aa, Artificial Sequence
  Description of Artificial Sequence: Synthetic peptide
  Nanobody sequence
WFRQAPGKEREFVA

SEQ ID NO: 275 - protein, 14 aa, Artificial Sequence
  Description of Artificial Sequence: Synthetic peptide
  Nanobody sequence
WFRQAPGKEREGVS

SEQ ID NO: 276 - protein, 14 aa, Artificial Sequence
  Description of Artificial Sequence: Synthetic peptide
  Nanobody sequence
WFRQAPGKEREGVS

SEQ ID NO: 277 - protein, 14 aa, Artificial Sequence
  Description of Artificial Sequence: Synthetic peptide
  Nanobody sequence
WFRQAPGKEREAVS

SEQ ID NO: 278 - protein, 14 aa, Artificial Sequence
  Description of Artificial Sequence: Synthetic peptide
  Nanobody sequence
WYRQAPGNQRELVA

SEQ ID NO: 279 - protein, 14 aa, Artificial Sequence
  Description of Artificial Sequence: Synthetic peptide
  Nanobody sequence
WYRQAPGKQRELVA

SEQ ID NO: 280 - protein, 14 aa, Artificial Sequence
  Description of Artificial Sequence: Synthetic peptide
  Nanobody sequence
WYRQAPGKQRELVA

SEQ ID NO: 281 - protein, 14 aa, Artificial Sequence
  Description of Artificial Sequence: Synthetic peptide
  Nanobody sequence
WFRQAPGKERDFVA

SEQ ID NO: 282 - protein, 14 aa, Artificial Sequence
  Description of Artificial Sequence: Synthetic peptide
  Nanobody sequence
WHRQAPGKQREFLA

SEQ ID NO: 283 - protein, 14 aa, Artificial Sequence
  Description of Artificial Sequence: Synthetic peptide
  Nanobody sequence
WYRQPPGLQREWVA

SEQ ID NO: 284 - protein, 14 aa, Artificial Sequence
  Description of Artificial Sequence: Synthetic peptide
  Nanobody sequence
WFRQAPGKEREGIS

SEQ ID NO: 285 - protein, 14 aa, Artificial Sequence
  Description of Artificial Sequence: Synthetic peptide
  Nanobody sequence
WFRQAPGKEREFVA

SEQ ID NO: 286 - protein, 14 aa, Artificial Sequence
  Description of Artificial Sequence: Synthetic peptide
  Nanobody sequence
WFRQAPGKEREFVA

SEQ ID NO: 287 - protein, 14 aa, Artificial Sequence
  Description of Artificial Sequence: Synthetic peptide
  Nanobody sequence
WFRQAPGKEREFVA

SEQ ID NO: 288 - protein, 14 aa, Artificial Sequence
  Description of Artificial Sequence: Synthetic peptide
  Nanobody sequence
WFRQAPGMEREFVA

SEQ ID NO: 289 - protein, 14 aa, Artificial Sequence
  Description of Artificial Sequence: Synthetic peptide
  Nanobody sequence
WFRRAPGKAREFVT

SEQ ID NO: 290 - protein, 14 aa, Artificial Sequence
  Description of Artificial Sequence: Synthetic peptide
  Nanobody sequence
WIRQAPGKQRELVA

SEQ ID NO: 291 - protein, 14 aa, Artificial Sequence
  Description of Artificial Sequence: Synthetic peptide
  Nanobody sequence
WFRQAPGKEREFVA

SEQ ID NO: 292 - protein, 14 aa, Artificial Sequence
  Description of Artificial Sequence: Synthetic peptide
  Nanobody sequence
WVRQAPGKGLEWVS

SEQ ID NO: 293 - protein, 14 aa, Artificial Sequence
  Description of Artificial Sequence: Synthetic peptide
  Nanobody sequence
WFRQAPGKEREFIG

SEQ ID NO: 294 - protein, 14 aa, Artificial Sequence
  Description of Artificial Sequence: Synthetic peptide
  Nanobody sequence
WFRQAPGKEREIVA

SEQ ID NO: 295 - protein, 14 aa, Artificial Sequence
  Description of Artificial Sequence: Synthetic peptide
  Nanobody sequence
WFRQAPGKEREGVS

SEQ ID NO: 296 - protein, 14 aa, Artificial Sequence
  Description of Artificial Sequence: Synthetic peptide
  Nanobody sequence
WARQAPGKGLEWIS

SEQ ID NO: 297 - protein, 14 aa, Artificial Sequence
  Description of Artificial Sequence: Synthetic peptide
  Nanobody sequence
WVRQAPGKGLEWIS

SEQ ID NO: 298 - protein, 14 aa, Artificial Sequence
  Description of Artificial Sequence: Synthetic peptide
  Nanobody sequence
WVRQAPGKGLEWIS

SEQ ID NO: 299 - protein, 14 aa, Artificial Sequence
  Description of Artificial Sequence: Synthetic peptide
  Nanobody sequence
WVRQAPGKGLEWIS

SEQ ID NO: 300 - protein, 14 aa, Artificial Sequence
  Description of Artificial Sequence: Synthetic peptide
  Nanobody sequence
WVRQAPGKGLEWIS

SEQ ID NO: 301 - protein, 14 aa, Artificial Sequence
  Description of Artificial Sequence: Synthetic peptide
  Nanobody sequence
WVRQAPGKGLEWIS

SEQ ID NO: 302 - protein, 14 aa, Artificial Sequence
  Description of Artificial Sequence: Synthetic peptide
  Nanobody sequence
WYRAAPGKQRELVA

SEQ ID NO: 303 - protein, 14 aa, Artificial Sequence
  Description of Artificial Sequence: Synthetic peptide
  Nanobody sequence
WYRAAPGKQRELVA

SEQ ID NO: 304 - protein, 14 aa, Artificial Sequence
  Description of Artificial Sequence: Synthetic peptide
  Nanobody sequence
WYRAAPGKQRELVA

SEQ ID NO: 305 - protein, 14 aa, Artificial Sequence
  Description of Artificial Sequence: Synthetic peptide
  Nanobody sequence
WYRAAPGKQRELVA

SEQ ID NO: 306 - protein, 14 aa, Artificial Sequence
  Description of Artificial Sequence: Synthetic peptide
  Nanobody sequence
WYRAAPGKQRELVA

SEQ ID NO: 307 - protein, 14 aa, Artificial Sequence
  Description of Artificial Sequence: Synthetic peptide
  Nanobody sequence
WFRQTPGKEREFVA

SEQ ID NO: 308 - protein, 14 aa, Artificial Sequence
  Description of Artificial Sequence: Synthetic peptide
  Nanobody sequence
WFRQTPGKEREFVA

SEQ ID NO: 309 - protein, 14 aa, Artificial Sequence
  Description of Artificial Sequence: Synthetic peptide
  Nanobody sequence
WLRQAPGKEREFVA

SEQ ID NO: 310 - protein, 14 aa, Artificial Sequence
  Description of Artificial Sequence: Synthetic peptide
  Nanobody sequence
WLRQAPGKEREFVA

SEQ ID NO: 311 - protein, 14 aa, Artificial Sequence
  Description of Artificial Sequence: Synthetic peptide
  Nanobody sequence
WLRQAPGKEREFVA

SEQ ID NO: 312 - protein, 14 aa, Artificial Sequence
  Description of Artificial Sequence: Synthetic peptide
  Nanobody sequence
WLRQAPGKEREFVA

SEQ ID NO: 313 - protein, 14 aa, Artificial Sequence
  Description of Artificial Sequence: Synthetic peptide
  Nanobody sequence
WFRQAPGKEREFVA

SEQ ID NO: 314 - protein, 14 aa, Artificial Sequence
  Description of Artificial Sequence: Synthetic peptide
  Nanobody sequence
WFRQAPGKDRRELV

SEQ ID NO: 315 - protein, 14 aa, Artificial Sequence
  Description of Artificial Sequence: Synthetic peptide
  Nanobody sequence
WFRQGPGKGRELVV

SEQ ID NO: 316 - protein, 14 aa, Artificial Sequence
  Description of Artificial Sequence: Synthetic peptide
  Nanobody sequence
WFRQAPGKDRRELV

SEQ ID NO: 317 - protein, 14 aa, Artificial Sequence
  Description of Artificial Sequence: Synthetic peptide
  Nanobody sequence
WFRQGPGKGRELVV

SEQ ID NO: 318 - protein, 14 aa, Artificial Sequence
  Description of Artificial Sequence: Synthetic peptide
  Nanobody sequence
WFRQGPGKGRELVV

SEQ ID NO: 319 - protein, 14 aa, Artificial Sequence
  Description of Artificial Sequence: Synthetic peptide
  Nanobody sequence
WFRQAPGKGRELIL

SEQ ID NO: 320 - protein, 14 aa, Artificial Sequence
  Description of Artificial Sequence: Synthetic peptide
  Nanobody sequence
WFRQAPGKDRRELV

SEQ ID NO: 321 - protein, 14 aa, Artificial Sequence
  Description of Artificial Sequence: Synthetic peptide
  Nanobody sequence
WFRQAPGKEREFVG

SEQ ID NO: 322 - protein, 14 aa, Artificial Sequence
  Description of Artificial Sequence: Synthetic peptide
  Nanobody sequence
WFRQAPGKEREFVA

SEQ ID NO: 323 - protein, 14 aa, Artificial Sequence
  Description of Artificial Sequence: Synthetic peptide
  Nanobody sequence
WFRQAPGKEREFVA

SEQ ID NO: 324 - protein, 14 aa, Artificial Sequence
  Description of Artificial Sequence: Synthetic peptide
  Nanobody sequence
WFRQAPGKEREFVA

SEQ ID NO: 325 - protein, 14 aa, Artificial Sequence
  Description of Artificial Sequence: Synthetic peptide
  Nanobody sequence
WFRQAPGKEREFVA

SEQ ID NO: 326 - protein, 14 aa, Artificial Sequence
  Description of Artificial Sequence: Synthetic peptide
  Nanobody sequence
WFRQAPGKEREFVA

SEQ ID NO: 327 - protein, 14 aa, Artificial Sequence
  Description of Artificial Sequence: Synthetic peptide
  Nanobody sequence
WFRQAPGKEREFVA

SEQ ID NO: 328 - protein, 14 aa, Artificial Sequence
  Description of Artificial Sequence: Synthetic peptide
  Nanobody sequence
WFRQAPGKEREFVA

SEQ ID NO: 329 - protein, 14 aa, Artificial Sequence
  Description of Artificial Sequence: Synthetic peptide
  Nanobody sequence
WFRQAPGKEREFVA

SEQ ID NO: 330 - protein, 14 aa, Artificial Sequence
  Description of Artificial Sequence: Synthetic peptide
  Nanobody sequence
WFRQAPGKEREFVA

SEQ ID NO: 331 - protein, 14 aa, Artificial Sequence
  Description of Artificial Sequence: Synthetic peptide
  Nanobody sequence
WFRQAPGKEREFVA

SEQ ID NO: 332 - protein, 14 aa, Artificial Sequence
  Description of Artificial Sequence: Synthetic peptide
  Nanobody sequence
WFRQAPGKEREFVA

SEQ ID NO: 333 - protein, 14 aa, Artificial Sequence
  Description of Artificial Sequence: Synthetic peptide
  Nanobody sequence
WFRQAPGKEREFVA

SEQ ID NO: 334 - protein, 14 aa, Artificial Sequence
  Description of Artificial Sequence: Synthetic peptide
  Nanobody sequence
WFRQAPGKEREFVA

SEQ ID NO: 335 - protein, 14 aa, Artificial Sequence
  Description of Artificial Sequence: Synthetic peptide
  Nanobody sequence
WFRQAPGKEREGVS

SEQ ID NO: 336 - protein, 14 aa, Artificial Sequence
  Description of Artificial Sequence: Synthetic peptide
  Nanobody sequence
WFRQAPGKEREFVA

SEQ ID NO: 337 - protein, 14 aa, Artificial Sequence
  Description of Artificial Sequence: Synthetic peptide
  Nanobody sequence
WFRQAPGKEREFVA

SEQ ID NO: 338 - protein, 14 aa, Artificial Sequence
  Description of Artificial Sequence: Synthetic peptide
  Nanobody sequence
WFREAPGKEREFVA

SEQ ID NO: 339 - protein, 17 aa, Artificial Sequence
  Description of Artificial Sequence: Synthetic peptide
  Nanobody sequence
AINWSGDNTHYADSVKG

SEQ ID NO: 340 - protein, 18 aa, Artificial Sequence
  Description of Artificial Sequence: Synthetic peptide
  Nanobody sequence
ADISWSALNTNYADSVKG

SEQ ID NO: 341 - protein, 17 aa, Artificial Sequence
  Description of Artificial Sequence: Synthetic peptide
  Nanobody sequence
DINSGGTRTTYADSVKG

SEQ ID NO: 342 - protein, 17 aa, Artificial Sequence
  Description of Artificial Sequence: Synthetic peptide
  Nanobody sequence
CISSSDGSIYYADSVKG

SEQ ID NO: 343 - protein, 17 aa, Artificial Sequence
  Description of Artificial Sequence: Synthetic peptide
  Nanobody sequence
CISSSDGIPYYSDFVKG

SEQ ID NO: 344 - protein, 17 aa, Artificial Sequence
  Description of Artificial Sequence: Synthetic peptide
  Nanobody sequence
HIPRSTYSPYYANSVKG

SEQ ID NO: 345 - protein, 17 aa, Artificial Sequence
  Description of Artificial Sequence: Synthetic peptide
  Nanobody sequence
AISATGDDTYYADSVKG

SEQ ID NO: 346 - protein, 17 aa, Artificial Sequence
  Description of Artificial Sequence: Synthetic peptide
  Nanobody sequence
CDSSSDGRTYYGDSVKG

SEQ ID NO: 347 - protein, 17 aa, Artificial Sequence
  Description of Artificial Sequence: Synthetic peptide
  Nanobody sequence
CDSSSDGDTYYANSVKG

SEQ ID NO: 348 - protein, 17 aa, Artificial Sequence
  Description of Artificial Sequence: Synthetic peptide
  Nanobody sequence
CFSSSDGSIYYADSVKG

SEQ ID NO: 349 - protein, 16 aa, Artificial Sequence
  Description of Artificial Sequence: Synthetic peptide
  Nanobody sequence
AMTSDATTEYADSVKG

SEQ ID NO: 350 - protein, 16 aa, Artificial Sequence
  Description of Artificial Sequence: Synthetic peptide
  Nanobody sequence
LITSGGGTTYGDSVKG

SEQ ID NO: 351 - protein, 16 aa, Artificial Sequence
  Description of Artificial Sequence: Synthetic peptide
  Nanobody sequence
LIFSGGSADYADSVKG

SEQ ID NO: 352 - protein, 17 aa, Artificial Sequence
  Description of Artificial Sequence: Synthetic peptide
  Nanobody sequence
AIRWSDGSSFYADSVKG

SEQ ID NO: 353 - protein, 16 aa, Artificial Sequence
  Description of Artificial Sequence: Synthetic peptide
  Nanobody sequence
SIASGGTTNYADSVKG

SEQ ID NO: 354 - protein, 17 aa, Artificial Sequence
  Description of Artificial Sequence: Synthetic peptide
  Nanobody sequence
IITSGGKTNYADSSVKG

SEQ ID NO: 355 - protein, 17 aa, Artificial Sequence
  Description of Artificial Sequence: Synthetic peptide
  Nanobody sequence
CITSSDASAYYTDSVKG

SEQ ID NO: 356 - protein, 17 aa, Artificial Sequence
  Description of Artificial Sequence: Synthetic peptide
  Nanobody sequence
VAHWSGAITSYADSVKG

SEQ ID NO: 357 - protein, 17 aa, Artificial Sequence
  Description of Artificial Sequence: Synthetic peptide
  Nanobody sequence
VLRWSDGHTAYADSVKG

SEQ ID NO: 358 - protein, 17 aa, Artificial Sequence
  Description of Artificial Sequence: Synthetic peptide
  Nanobody sequence
VFRWSDSHTAYADSVKG

SEQ ID NO: 359 - protein, 17 aa, Artificial Sequence
  Description of Artificial Sequence: Synthetic peptide
  Nanobody sequence
LIRWSDGITGYVDSVKG

SEQ ID NO: 360 - protein, 17 aa, Artificial Sequence
  Description of Artificial Sequence: Synthetic peptide
  Nanobody sequence
LISWSSGRTSYADSVKG

SEQ ID NO: 361 - protein, 16 aa, Artificial Sequence
  Description of Artificial Sequence: Synthetic peptide
  Nanobody sequence
TITVGGSTNYADSAKG

SEQ ID NO: 362 - protein, 17 aa, Artificial Sequence
  Description of Artificial Sequence: Synthetic peptide
  Nanobody sequence
VLRWSDSHTAYADSVEG

SEQ ID NO: 363 - protein, 17 aa, Artificial Sequence
  Description of Artificial Sequence: Synthetic peptide
  Nanobody sequence
STSTGGEMTNYADSVKG

SEQ ID NO: 364 - protein, 17 aa, Artificial Sequence
  Description of Artificial Sequence: Synthetic peptide
  Nanobody sequence
AISGSGDSIYYAVSEKD

SEQ ID NO: 365 - protein, 16 aa, Artificial Sequence
  Description of Artificial Sequence: Synthetic peptide
  Nanobody sequence
RISTNGPTAYAEFVKG

SEQ ID NO: 366 - protein, 17 aa, Artificial Sequence
  Description of Artificial Sequence: Synthetic peptide
  Nanobody sequence
CFTSSDGRTFYADSVKG

SEQ ID NO: 367 - protein, 17 aa, Artificial Sequence
  Description of Artificial Sequence: Synthetic peptide
  Nanobody sequence
ALAPGGDDEYYADSVNG

SEQ ID NO: 368 - protein, 17 aa, Artificial Sequence
  Description of Artificial Sequence: Synthetic peptide
  Nanobody sequence
ALAPGGDNRYYADSVNG

SEQ ID NO: 369 - protein, 17 aa, Artificial Sequence
  Description of Artificial Sequence: Synthetic peptide
  Nanobody sequence
ALAPGGGNRYYAESVNG

SEQ ID NO: 370 - protein, 17 aa, Artificial Sequence
  Description of Artificial Sequence: Synthetic peptide
  Nanobody sequence
ALAPGGDNRYYADSVNG

SEQ ID NO: 371 - protein, 17 aa, Artificial Sequence
  Description of Artificial Sequence: Synthetic peptide
  Nanobody sequence
ALAPGGEHRYYADSVNG

SEQ ID NO: 372 - protein, 17 aa, Artificial Sequence
  Description of Artificial Sequence: Synthetic peptide
  Nanobody sequence
ALAPGGGNAYYADSVNG

SEQ ID NO: 373 - protein, 16 aa, Artificial Sequence
  Description of Artificial Sequence: Synthetic peptide
  Nanobody sequence
IIINGGSTNYADSVKG

SEQ ID NO: 374 - protein, 16 aa, Artificial Sequence
  Description of Artificial Sequence: Synthetic peptide
  Nanobody sequence
IIANGGSTNYADSVKG

SEQ ID NO: 375 - protein, 16 aa, Artificial Sequence
  Description of Artificial Sequence: Synthetic peptide
  Nanobody sequence
IIVNGGSTNYADSVKG

SEQ ID NO: 376 - protein, 16 aa, Artificial Sequence
  Description of Artificial Sequence: Synthetic peptide
  Nanobody sequence
IIVNGGSTNYADSVKG

SEQ ID NO: 377 - protein, 16 aa, Artificial Sequence
  Description of Artificial Sequence: Synthetic peptide
  Nanobody sequence
IIVNGGSTNYADSVKG

SEQ ID NO: 378 - protein, 17 aa, Artificial Sequence
  Description of Artificial Sequence: Synthetic peptide
  Nanobody sequence
GIRWSDAYTEYANSVKG

SEQ ID NO: 379 - protein, 17 aa, Artificial Sequence
  Description of Artificial Sequence: Synthetic peptide
  Nanobody sequence
GIRWTDAYTEYAASVKG

SEQ ID NO: 380 - protein, 17 aa, Artificial Sequence
  Description of Artificial Sequence: Synthetic peptide
  Nanobody sequence
AISGSGDDTYYADSVKG

SEQ ID NO: 381 - protein, 17 aa, Artificial Sequence
  Description of Artificial Sequence: Synthetic peptide
  Nanobody sequence
AISGSGDDTYYADSVKG

SEQ ID NO: 382 - protein, 17 aa, Artificial Sequence
  Description of Artificial Sequence: Synthetic peptide
  Nanobody sequence
AISGSGDDTYYADSVKG

SEQ ID NO: 383 - protein, 17 aa, Artificial Sequence
  Description of Artificial Sequence: Synthetic peptide
  Nanobody sequence
AVSGSGDDTYYADSVKG

SEQ ID NO: 384 - protein, 17 aa, Artificial Sequence
  Description of Artificial Sequence: Synthetic peptide
  Nanobody sequence
AISGSGEDTYYADSVKG

SEQ ID NO: 385 - protein, 18 aa, Artificial Sequence
  Description of Artificial Sequence: Synthetic peptide
  Nanobody sequence
VSIFRTGSITYTADSVKG

SEQ ID NO: 386 - protein, 17 aa, Artificial Sequence
  Description of Artificial Sequence: Synthetic peptide
  Nanobody sequence
SIFRSGTITYTADSVKG

SEQ ID NO: 387 - protein, 18 aa, Artificial Sequence
  Description of Artificial Sequence: Synthetic peptide
  Nanobody sequence
VSIFRTGSITYTADSVKG

SEQ ID NO: 388 - protein, 17 aa, Artificial Sequence
  Description of Artificial Sequence: Synthetic peptide
  Nanobody sequence
SIFRSGTITYTADSVKG

SEQ ID NO: 389 - protein, 17 aa, Artificial Sequence
  Description of Artificial Sequence: Synthetic peptide
  Nanobody sequence
SIFRSGTITYTADSVKG

SEQ ID NO: 390 - protein, 17 aa, Artificial Sequence
  Description of Artificial Sequence: Synthetic peptide
  Nanobody sequence
SIFRSGSITYTADSVKG

SEQ ID NO: 391 - protein, 18 aa, Artificial Sequence
  Description of Artificial Sequence: Synthetic peptide
  Nanobody sequence
VSIFRTGSITYTADSVKG

SEQ ID NO: 392 - protein, 17 aa, Artificial Sequence
  Description of Artificial Sequence: Synthetic peptide
  Nanobody sequence
AISMSGEDTIYATSVKG

SEQ ID NO: 393 - protein, 17 aa, Artificial Sequence
  Description of Artificial Sequence: Synthetic peptide
  Nanobody sequence
AISMSGEDAAYATSVKG

SEQ ID NO: 394 - protein, 17 aa, Artificial Sequence
  Description of Artificial Sequence: Synthetic peptide
  Nanobody sequence
AISMSGDDTAYATFVKG

SEQ ID NO: 395 - protein, 17 aa, Artificial Sequence
  Description of Artificial Sequence: Synthetic peptide
  Nanobody sequence
AISMSGDDAAYADFVRG

SEQ ID NO: 396 - protein, 17 aa, Artificial Sequence
  Description of Artificial Sequence: Synthetic peptide
  Nanobody sequence
AISMSGDDTAYTDFVRG

SEQ ID NO: 397 - protein, 17 aa, Artificial Sequence
  Description of Artificial Sequence: Synthetic peptide
  Nanobody sequence
AISMSGDDAAYADFVRG

SEQ ID NO: 398 - protein, 17 aa, Artificial Sequence
  Description of Artificial Sequence: Synthetic peptide
  Nanobody sequence
AISMSGDDTIYRDFVKG

SEQ ID NO: 399 - protein, 17 aa, Artificial Sequence
  Description of Artificial Sequence: Synthetic peptide
  Nanobody sequence
AISMSGDDTAYATFVKG

SEQ ID NO: 400 - protein, 17 aa, Artificial Sequence
  Description of Artificial Sequence: Synthetic peptide
  Nanobody sequence
AISMSGDDTAVATFVKG

SEQ ID NO: 401 - protein, 17 aa, Artificial Sequence
  Description of Artificial Sequence: Synthetic peptide
  Nanobody sequence
AISMSGDDTAVATFVKG

SEQ ID NO: 402 - protein, 17 aa, Artificial Sequence
  Description of Artificial Sequence: Synthetic peptide
  Nanobody sequence
AISMSGDDTAYATFVKG

SEQ ID NO: 403 - protein, 17 aa, Artificial Sequence
  Description of Artificial Sequence: Synthetic peptide
  Nanobody sequence
AISMSGDDSAYRDFVKG

SEQ ID NO: 404 - protein, 17 aa, Artificial Sequence
  Description of Artificial Sequence: Synthetic peptide
  Nanobody sequence
AISMSGDDTAYATFVKG

SEQ ID NO: 405 - protein, 17 aa, Artificial Sequence
  Description of Artificial Sequence: Synthetic peptide
  Nanobody sequence
AISMSGDDAAYADFVRG

SEQ ID NO: 406 - protein, 17 aa, Artificial Sequence
  Description of Artificial Sequence: Synthetic peptide
  Nanobody sequence
CVSSSDGRTAYADSVKG

SEQ ID NO: 407 - protein, 17 aa, Artificial Sequence
  Description of Artificial Sequence: Synthetic peptide
  Nanobody sequence
GISWTGGTTYYADSVKG

SEQ ID NO: 408 - protein, 17 aa, Artificial Sequence
  Description of Artificial Sequence: Synthetic peptide
  Nanobody sequence
GISWTGGTTYYADSVKG

SEQ ID NO: 409 - protein, 17 aa, Artificial Sequence
  Description of Artificial Sequence: Synthetic peptide
  Nanobody sequence
AIRWSDGSSYYADSVKG

SEQ ID NO: 410 - protein, 32 aa, Artificial Sequence
  Description of Artificial Sequence: Synthetic polypeptide
  Nanobody sequence
RFTISRDNAKNTVSLQMNSLKPEDTAVYYCAA

SEQ ID NO: 411 - protein, 32 aa, Artificial Sequence
  Description of Artificial Sequence: Synthetic polypeptide
  Nanobody sequence
RFTISRDNAKNMVYLQMNNLKPEDTAVYYCAA

SEQ ID NO: 412 - protein, 32 aa, Artificial Sequence
  Description of Artificial Sequence: Synthetic polypeptide
  Nanobody sequence
RFTISRDNAKNTLYLQMNSLKPEDTAVYVCAK

SEQ ID NO: 413 - protein, 32 aa, Artificial Sequence
  Description of Artificial Sequence: Synthetic polypeptide
  Nanobody sequence
RFTISSDNAKNTVYLQMNSLKPEDTAVYHCAR

SEQ ID NO: 414 - protein, 32 aa, Artificial Sequence
  Description of Artificial Sequence: Synthetic polypeptide
  Nanobody sequence
RFTTSIDNAKNTVYLQMNSLKPEDTAVYYCAA

SEQ ID NO: 415 - protein, 32 aa, Artificial Sequence
  Description of Artificial Sequence: Synthetic polypeptide
  Nanobody sequence
RFTIARDDAKSTVYLQMNSLKPEDTAVYYCAV

SEQ ID NO: 416 - protein, 32 aa, Artificial Sequence
  Description of Artificial Sequence: Synthetic polypeptide
  Nanobody sequence
RFAISRDTARNTVYLQMNSLKPEDTAVYYCGA

SEQ ID NO: 417 - protein, 32 aa, Artificial Sequence
  Description of Artificial Sequence: Synthetic polypeptide
  Nanobody sequence
RFTISTDSAKNTVYLQMNSLKPEDTAVYYCAT

SEQ ID NO: 418 - protein, 32 aa, Artificial Sequence
  Description of Artificial Sequence: Synthetic polypeptide
  Nanobody sequence
RFTISTDNGKNTVYLQMNSLKPEDTAVYYCAT

SEQ ID NO: 419 - protein, 32 aa, Artificial Sequence
  Description of Artificial Sequence: Synthetic polypeptide
  Nanobody sequence
RFTISSDNAKNTVYLQMNSLKPEDTAVYYCAG

SEQ ID NO: 420 - protein, 32 aa, Artificial Sequence
  Description of Artificial Sequence: Synthetic polypeptide
  Nanobody sequence
RFTISRDIPENTVYLQMNSLKPEDTAVYYCNA

SEQ ID NO: 421 - protein, 32 aa, Artificial Sequence
  Description of Artificial Sequence: Synthetic polypeptide
  Nanobody sequence
RFTISIDNAKNTVILQMNSLEAEDTAVYYCAA

SEQ ID NO: 422 - protein, 32 aa, Artificial Sequence
  Description of Artificial Sequence: Synthetic polypeptide
  Nanobody sequence
RFTISRDNAKNTVYLEMNSLKAEDTAVYYCAA

SEQ ID NO: 423 - protein, 32 aa, Artificial Sequence
  Description of Artificial Sequence: Synthetic polypeptide
  Nanobody sequence
RFTISRDNAKNAVYLQSNSLKSEDTAVYVCYA

SEQ ID NO: 424 - protein, 32 aa, Artificial Sequence
  Description of Artificial Sequence: Synthetic polypeptide
  Nanobody sequence
RFTISRDNAKNTVYLQMNSLKPEDTAVYYCGA

SEQ ID NO: 425 - protein, 32 aa, Artificial Sequence
  Description of Artificial Sequence: Synthetic polypeptide
  Nanobody sequence
RFTVSVDKVKNTVTLQMNSLKPEDTAVYYCYA

SEQ ID NO: 426 - protein, 32 aa, Artificial Sequence
  Description of Artificial Sequence: Synthetic polypeptide
  Nanobody sequence
RFTISRDNSKNTVYLQMNSLKTEDTAIYYCAA

SEQ ID NO: 427 - protein, 32 aa, Artificial Sequence
  Description of Artificial Sequence: Synthetic polypeptide
  Nanobody sequence
RFTFSRDNAKNTMNLQMNSLKPEDTAVYYCAA

SEQ ID NO: 428 - protein, 32 aa, Artificial Sequence
  Description of Artificial Sequence: Synthetic polypeptide
  Nanobody sequence
RFTISRDGAKNTMYLQMSSLKPEDTAIYYCTT

SEQ ID NO: 429 - protein, 32 aa, Artificial Sequence
  Description of Artificial Sequence: Synthetic polypeptide
  Nanobody sequence
RFTISRDGAKNTLYLQMSSLKPEDTAIYYCTT

SEQ ID NO: 430 - protein, 32 aa, Artificial Sequence; identical to SEQ ID NO: 112
  Description of Artificial Sequence: Synthetic polypeptide
  Nanobody sequence

SEQ ID NO: 431 - protein, 32 aa, Artificial Sequence
  Description of Artificial Sequence: Synthetic polypeptide
  Nanobody sequence
RFTISRDSAKNAVYLQMDNLKPEDTAVYFCAV

SEQ ID NO: 432 - protein, 32 aa, Artificial Sequence
  Description of Artificial Sequence: Synthetic polypeptide
  Nanobody sequence
RFTISRDNAKNTVYLQMSSLKPEDTAVYYCNA

SEQ ID NO: 433 - protein, 32 aa, Artificial Sequence
  Description of Artificial Sequence: Synthetic polypeptide
  Nanobody sequence
RFTISRDGAKNTVYLQMSSLKPEDTAIYYCTT

SEQ ID NO: 434 - protein, 32 aa, Artificial Sequence
  Description of Artificial Sequence: Synthetic polypeptide
  Nanobody sequence
RFTISRDNAKNTLHLQMNSLKPEDTALYYCAA

SEQ ID NO: 435 - protein, 32 aa, Artificial Sequence
  Description of Artificial Sequence: Synthetic polypeptide
  Nanobody sequence
RFTISRDNGKNTLYLQMSSLKAEDTAVYYCTA

SEQ ID NO: 436 - protein, 32 aa, Artificial Sequence
  Description of Artificial Sequence: Synthetic polypeptide
  Nanobody sequence
RFTVSRENTKNTVYLQMNSLNIEDTAVYYCAA

SEQ ID NO: 437 - protein, 32 aa, Artificial Sequence
  Description of Artificial Sequence: Synthetic polypeptide
  Nanobody sequence
RFTVSADNAKNTVYLQMNSLEPEDTAVYFCAA

SEQ ID NO: 438 - protein, 32 aa, Artificial Sequence
  Description of Artificial Sequence: Synthetic polypeptide
  Nanobody sequence
RFTISRDNAENSLYLQMNSLKSEDTAVYYCAK

SEQ ID NO: 439 - protein, 32 aa, Artificial Sequence; identical to SEQ ID NO: 438
  Description of Artificial Sequence: Synthetic polypeptide
  Nanobody sequence

SEQ ID NO: 440 - protein, 32 aa, Artificial Sequence
  Description of Artificial Sequence: Synthetic polypeptide
  Nanobody sequence
RFTISRDNAKNSLYLQMNSLKSEDTAVYYCAK

SEQ ID NO: 441 - protein, 32 aa, Artificial Sequence; identical to SEQ ID NO: 438
  Description of Artificial Sequence: Synthetic polypeptide
  Nanobody sequence

SEQ ID NO: 442 - protein, 32 aa, Artificial Sequence; identical to SEQ ID NO: 440
  Description of Artificial Sequence: Synthetic polypeptide
  Nanobody sequence

SEQ ID NO: 443 - protein, 32 aa, Artificial Sequence
  Description of Artificial Sequence: Synthetic polypeptide
  Nanobody sequence
RFTISRDNAENLLYLQMNSLKSEDTAVYYCAK

SEQ ID NO: 444 - protein, 32 aa, Artificial Sequence
  Description of Artificial Sequence: Synthetic polypeptide
  Nanobody sequence
RFTISRDSAKNAVYLQMNSLKPEDTAVYYCYY

SEQ ID NO: 445 - protein, 32 aa, Artificial Sequence; identical to SEQ ID NO: 444
  Description of Artificial Sequence: Synthetic polypeptide
  Nanobody sequence

SEQ ID NO: 446 - protein, 32 aa, Artificial Sequence; identical to SEQ ID NO: 444
  Description of Artificial Sequence: Synthetic polypeptide
  Nanobody sequence

SEQ ID NO: 447 - protein, 32 aa, Artificial Sequence
  Description of Artificial Sequence: Synthetic polypeptide
  Nanobody sequence
RFTISRDSAKNAVYLQMDSLKPEDTAVYYCYY

SEQ ID NO: 448 - protein, 32 aa, Artificial Sequence
  Description of Artificial Sequence: Synthetic polypeptide
  Nanobody sequence
RFTISRDNAKNAVYLQMNSLKPEDTAVYYCYY

SEQ ID NO: 449 - protein, 32 aa, Artificial Sequence
  Description of Artificial Sequence: Synthetic polypeptide
  Nanobody sequence
RFTISRDNAKNTVDLQMDSLKPEDTAVYYCVL

SEQ ID NO: 450 - protein, 32 aa, Artificial Sequence
  Description of Artificial Sequence: Synthetic polypeptide
  Nanobody sequence
RFTISRDNAKNTVGLQMDSLKPEDTAVYYCVL

SEQ ID NO: 451 - protein, 32 aa, Artificial Sequence
  Description of Artificial Sequence: Synthetic polypeptide
  Nanobody sequence
RFTISKDNAGITMYLQMNSLKPEDTAVYYCAT

SEQ ID NO: 452 - protein, 32 aa, Artificial Sequence
  Description of Artificial Sequence: Synthetic polypeptide
  Nanobody sequence
RFTISKDNAGITMYLEMNSLKPEDTAVYYCAT

SEQ ID NO: 453 - protein, 32 aa, Artificial Sequence; identical to SEQ ID NO: 451
  Description of Artificial Sequence: Synthetic polypeptide
  Nanobody sequence

SEQ ID NO: 454 - protein, 32 aa, Artificial Sequence; identical to SEQ ID NO: 451
  Description of Artificial Sequence: Synthetic polypeptide
  Nanobody sequence

SEQ ID NO: 455 - protein, 32 aa, Artificial Sequence
  Description of Artificial Sequence: Synthetic polypeptide
  Nanobody sequence
RFTCSKDNAKDTMYLQMNSLKPEDTAVYYCAT

SEQ ID NO: 456 - protein, 32 aa, Artificial Sequence
  Description of Artificial Sequence: Synthetic polypeptide
  Nanobody sequence
RFTASRVNTKNTVYLQMNSLKPEDTAVYYCAS

SEQ ID NO: 457 - protein, 32 aa, Artificial Sequence
  Description of Artificial Sequence: Synthetic polypeptide
  Nanobody sequence
RFTASRVNTKNTVYLQMNSLKPEDTGIYYCAS

SEQ ID NO: 458 - protein, 32 aa, Artificial Sequence; identical to SEQ ID NO: 456
  Description of Artificial Sequence: Synthetic polypeptide
  Nanobody sequence

SEQ ID NO: 459 - protein, 32 aa, Artificial Sequence; identical to SEQ ID NO: 457
  Description of Artificial Sequence: Synthetic polypeptide
  Nanobody sequence

SEQ ID NO: 460 - protein, 32 aa, Artificial Sequence; identical to SEQ ID NO: 457
  Description of Artificial Sequence: Synthetic polypeptide
  Nanobody sequence

SEQ ID NO: 461 - protein, 32 aa, Artificial Sequence
  Description of Artificial Sequence: Synthetic polypeptide
  Nanobody sequence
RFTGSRVNTKNTAYLQMNNLKPEDTAVYYCAS

SEQ ID NO: 462 - protein, 32 aa, Artificial Sequence; identical to SEQ ID NO: 456
  Description of Artificial Sequence: Synthetic polypeptide
  Nanobody sequence

SEQ ID NO: 463 - protein, 32 aa, Artificial Sequence
  Description of Artificial Sequence: Synthetic polypeptide
  Nanobody sequence
RFTISRDDARNTVTLHMTSLKPEDTAVYYCAA

SEQ ID NO: 464 - protein, 32 aa, Artificial Sequence
  Description of Artificial Sequence: Synthetic polypeptide
  Nanobody sequence
RFTISRDNARNTVYLHMTTLKPEDTAVYYCAA

SEQ ID NO: 465 - protein, 32 aa, Artificial Sequence
  Description of Artificial Sequence: Synthetic polypeptide
  Nanobody sequence
RFTIVRDDDKNTVYLHMTSLKPEDTAVYYCAA

SEQ ID NO: 466 - protein, 32 aa, Artificial Sequence
  Description of Artificial Sequence: Synthetic polypeptide
  Nanobody sequence
RFTISRDDARNTVYLHMTSLKPEDTAVYYCAA

SEQ ID NO: 467 - protein, 32 aa, Artificial Sequence; identical to SEQ ID NO: 466
  Description of Artificial Sequence: Synthetic polypeptide
  Nanobody sequence

SEQ ID NO: 468 - protein, 32 aa, Artificial Sequence; identical to SEQ ID NO: 466
  Description of Artificial Sequence: Synthetic polypeptide
  Nanobody sequence

SEQ ID NO: 469 - protein, 32 aa, Artificial Sequence
  Description of Artificial Sequence: Synthetic polypeptide
  Nanobody sequence
RFTISRDNARNTVYLHMTSLKPEDTAVYYCAA

SEQ ID NO: 470 - protein, 32 aa, Artificial Sequence
  Description of Artificial Sequence: Synthetic polypeptide
  Nanobody sequence
RFTISRDSARNTVYLHMTRLKPEDTAVYSCAA

SEQ ID NO: 471 - protein, 32 aa, Artificial Sequence
  Description of Artificial Sequence: Synthetic polypeptide
  Nanobody sequence
RFTISRDNARNTVYLHMTSLKPEDTAVYHCAA

SEQ ID NO: 472 - protein, 32 aa, Artificial Sequence
  Description of Artificial Sequence: Synthetic polypeptide
  Nanobody sequence
RFTISRDNARNTVYLHMSSLKPEDTAVYHCAA

SEQ ID NO: 473 - protein, 32 aa, Artificial Sequence
  Description of Artificial Sequence: Synthetic polypeptide
  Nanobody sequence
RFTFSRDDDKNTVYLHMTSLKPEDTAVYYCAA

SEQ ID NO: 474 - protein, 32 aa, Artificial Sequence
  Description of Artificial Sequence: Synthetic polypeptide
  Nanobody sequence
RFTISRDNARDTVYLHMTSLKPEDTAIYYCAA

SEQ ID NO: 475 - protein, 32 aa, Artificial Sequence
  Description of Artificial Sequence: Synthetic polypeptide
  Nanobody sequence
RFTISRDNARNTVYLHMTRLKPEDTAVYSCAA

SEQ ID NO: 476 - protein, 32 aa, Artificial Sequence; identical to SEQ ID NO: 466
  Description of Artificial Sequence: Synthetic polypeptide
  Nanobody sequence

SEQ ID NO: 477 - protein, 32 aa, Artificial Sequence
  Description of Artificial Sequence: Synthetic polypeptide
  Nanobody sequence
RFTISRDNAKNTVYLQMNSLKPEDTAVYYCAT

SEQ ID NO: 478 - protein, 32 aa, Artificial Sequence
  Description of Artificial Sequence: Synthetic polypeptide
  Nanobody sequence
RFTMSADNAKNTVYLQMNSLKPEDTAVYYCAV

SEQ ID NO: 479 - protein, 32 aa, Artificial Sequence; identical to SEQ ID NO: 478
  Description of Artificial Sequence: Synthetic polypeptide
  Nanobody sequence

SEQ ID NO: 480 - protein, 32 aa, Artificial Sequence
  Description of Artificial Sequence: Synthetic polypeptide
  Nanobody sequence
RFTISRDNAKNAVHLQSNSLKSEDTAVYYCYA

SEQ ID NO: 481 - protein, 16 aa, Artificial Sequence
  Description of Artificial Sequence: Synthetic peptide
  Nanobody sequence
QLGYESGYSLTYDYDY

SEQ ID NO: 482 - protein, 10 aa, Artificial Sequence
  Description of Artificial Sequence: Synthetic peptide
  Nanobody sequence
RRSGYASFDN

SEQ ID NO: 483 - protein, 19 aa, Artificial Sequence
  Description of Artificial Sequence: Synthetic peptide
  Nanobody sequence
LSVFRSQLGGKYYGGDYEN

SEQ ID NO: 484 - protein, 15 aa, Artificial Sequence
  Description of Artificial Sequence: Synthetic peptide
  Nanobody sequence
FGRTGWAEECVDYDY

SEQ ID NO: 485 - protein, 11 aa, Artificial Sequence
  Description of Artificial Sequence: Synthetic peptide
  Nanobody sequence
GFGRLCAEFDS

SEQ ID NO: 486 - protein, 14 aa, Artificial Sequence
  Description of Artificial Sequence: Synthetic peptide
  Nanobody sequence
FTGGTYYVPTAYDY

SEQ ID NO: 487 - protein, 16 aa, Artificial Sequence
  Description of Artificial Sequence: Synthetic peptide
  Nanobody sequence
RVNFDGTVSYTNDYAY

SEQ ID NO: 488 - protein, 8 aa, Artificial Sequence
  Description of Artificial Sequence: Synthetic peptide
  Nanobody sequence
CTDFEYDY

SEQ ID NO: 489 - protein, 8 aa, Artificial Sequence
  Description of Artificial Sequence: Synthetic peptide
  Nanobody sequence
CTDWNYDY

SEQ ID NO: 490 - protein, 18 aa, Artificial Sequence
  Description of Artificial Sequence: Synthetic peptide
  Nanobody sequence
GGGSYYYTQLNYCYDMDY

SEQ ID NO: 491 - protein, 15 aa, Artificial Sequence
  Description of Artificial Sequence: Synthetic peptide
  Nanobody sequence
KGIWDYLGRRDFGDY

SEQ ID NO: 492 - protein, 16 aa, Artificial Sequence
  Description of Artificial Sequence: Synthetic peptide
  Nanobody sequence
EIGYYSGGTYFSSEAH

SEQ ID NO: 493 - protein, 16 aa, Artificial Sequence
  Description of Artificial Sequence: Synthetic peptide
  Nanobody sequence
EIGYYSGGTYYSSEAH

SEQ ID NO: 494 - protein, 11 aa, Artificial Sequence
  Description of Artificial Sequence: Synthetic peptide
  Nanobody sequence
DVEGPTALHKY

SEQ ID NO: 495 - protein, 9 aa, Artificial Sequence
  Description of Artificial Sequence: Synthetic peptide
  Nanobody sequence
NAESGPYTY

SEQ ID NO: 496 - protein, 7 aa, Artificial Sequence
  Description of Artificial Sequence: Synthetic peptide
  Nanobody sequence
QWMGRDY

SEQ ID NO: 497 - protein, 14 aa, Artificial Sequence
  Description of Artificial Sequence: Synthetic peptide
  Nanobody sequence
ALLTCSSYYDAYTY

SEQ ID NO: 498 - protein, 10 aa, Artificial Sequence
  Description of Artificial Sequence: Synthetic peptide
  Nanobody sequence
DSETSGNWVY

SEQ ID NO: 499 - protein, 9 aa, Artificial Sequence
  Description of Artificial Sequence: Synthetic peptide
  Nanobody sequence
ATRPGEWDY

SEQ ID NO: 500 - protein, 9 aa, Artificial Sequence
  Description of Artificial Sequence: Synthetic peptide
  Nanobody sequence
ATRPGEWDY

SEQ ID NO: 501 - protein, 9 aa, Artificial Sequence
  Description of Artificial Sequence: Synthetic peptide
  Nanobody sequence
AVRPGDYDY

SEQ ID NO: 502 - protein, 10 aa, Artificial Sequence
  Description of Artificial Sequence: Synthetic peptide
  Nanobody sequence
DLSGDAVYDS

SEQ ID NO: 503 - protein, 15 aa, Artificial Sequence
  Description of Artificial Sequence: Synthetic peptide
  Nanobody sequence
VATVTDYTGTYSDGF

SEQ ID NO: 504 - protein, 9 aa, Artificial Sequence
  Description of Artificial Sequence: Synthetic peptide
  Nanobody sequence
GTRPGEWHY

SEQ ID NO: 505 - protein, 9 aa, Artificial Sequence
  Description of Artificial Sequence: Synthetic peptide
  Nanobody sequence
GTSAGHWST

SEQ ID NO: 506 - protein, 14 aa, Artificial Sequence
  Description of Artificial Sequence: Synthetic peptide
  Nanobody sequence
DQEFGYLRFGRSEY

SEQ ID NO: 507 - protein, 11 aa, Artificial Sequence
  Description of Artificial Sequence: Synthetic peptide
  Nanobody sequence
GYDSLFAGYDY

SEQ ID NO: 508 - protein, 19 aa, Artificial Sequence
  Description of Artificial Sequence: Synthetic peptide
  Nanobody sequence
VNTFDESAYAAFACYDVVR

SEQ ID NO: 509 - protein, 13 aa, Artificial Sequence
  Description of Artificial Sequence: Synthetic peptide
  Nanobody sequence
DHNVGYRTGEYDY

SEQ ID NO: 510 - protein, 13 aa, Artificial Sequence
  Description of Artificial Sequence: Synthetic peptide
  Nanobody sequence
DHNVGYRTGEYDY

SEQ ID NO: 511 - protein, 13 aa, Artificial Sequence
  Description of Artificial Sequence: Synthetic peptide
  Nanobody sequence
DHNVGYRTGEYDY

SEQ ID NO: 512 - protein, 13 aa, Artificial Sequence
  Description of Artificial Sequence: Synthetic peptide
  Nanobody sequence
DHNVGYRTGEYDY

SEQ ID NO: 513 - protein, 13 aa, Artificial Sequence
  Description of Artificial Sequence: Synthetic peptide
  Nanobody sequence
DHNVGYRTGEYDY

SEQ ID NO: 514 - protein, 13 aa, Artificial Sequence
  Description of Artificial Sequence: Synthetic peptide
  Nanobody sequence
DHNVGYRTGEYDY

SEQ ID NO: 515 - protein, 7 aa, Artificial Sequence
  Description of Artificial Sequence: Synthetic peptide
  Nanobody sequence
NIPGDVY

SEQ ID NO: 516 - protein, 7 aa, Artificial Sequence
  Description of Artificial Sequence: Synthetic peptide
  Nanobody sequence
NIPGDVY

SEQ ID NO: 517 - protein, 7 aa, Artificial Sequence
  Description of Artificial Sequence: Synthetic peptide
  Nanobody sequence
NIPGDVY

SEQ ID NO: 518 - protein, 7 aa, Artificial Sequence
  Description of Artificial Sequence: Synthetic peptide
  Nanobody sequence
NIPGDVY

SEQ ID NO: 519 - protein, 7 aa, Artificial Sequence
  Description of Artificial Sequence: Synthetic peptide
  Nanobody sequence
NIPGDVY

SEQ ID NO: 520 - protein, 7 aa, Artificial Sequence
  Description of Artificial Sequence: Synthetic peptide
  Nanobody sequence
DLSTVRY

SEQ ID NO: 521 - protein, 7 aa, Artificial Sequence
  Description of Artificial Sequence: Synthetic peptide
  Nanobody sequence
DLSTVRY

SEQ ID NO: 522 - protein, 15 aa, Artificial Sequence
  Description of Artificial Sequence: Synthetic peptide
  Nanobody sequence
RRGLYYVWDSNDYEN

SEQ ID NO: 523 - protein, 15 aa, Artificial Sequence
  Description of Artificial Sequence: Synthetic peptide
  Nanobody sequence
RRGRYYVWDSNDYEN

SEQ ID NO: 524 - protein, 15 aa, Artificial Sequence
  Description of Artificial Sequence: Synthetic peptide
  Nanobody sequence
RRGLYYVWDSNDYEN

SEQ ID NO: 525 - protein, 15 aa, Artificial Sequence
  Description of Artificial Sequence: Synthetic peptide
  Nanobody sequence
RRGLYYVWDSNDYEN

SEQ ID NO: 526 - protein, 15 aa, Artificial Sequence
  Description of Artificial Sequence: Synthetic peptide
  Nanobody sequence
RRGLYFITDSNDYEN

SEQ ID NO: 527 - protein, 10 aa, Artificial Sequence
  Description of Artificial Sequence: Synthetic peptide
  Nanobody sequence
AYNPGVGYDY

SEQ ID NO: 528 - protein, 10 aa, Artificial Sequence
  Description of Artificial Sequence: Synthetic peptide
  Nanobody sequence
AYNPGIGYDY

SEQ ID NO: 529 - protein, 10 aa, Artificial Sequence
  Description of Artificial Sequence: Synthetic peptide
  Nanobody sequence
AYNPGVGYDY

SEQ ID NO: 530 - protein, 10 aa, Artificial Sequence
  Description of Artificial Sequence: Synthetic peptide
  Nanobody sequence
AYNPGIGYDY

SEQ ID NO: 531 - protein, 10 aa, Artificial Sequence
  Description of Artificial Sequence: Synthetic peptide
  Nanobody sequence
AYNPGIGYDY

SEQ ID NO: 532 - protein, 10 aa, Artificial Sequence
  Description of Artificial Sequence: Synthetic peptide
  Nanobody sequence
AYNPGIGYDY

SEQ ID NO: 533 - protein, 10 aa, Artificial Sequence
  Description of Artificial Sequence: Synthetic peptide
  Nanobody sequence
AYNPGVGYDY

SEQ ID NO: 534 - protein, 16 aa, Artificial Sequence
  Description of Artificial Sequence: Synthetic peptide
  Nanobody sequence
RTSYNGRYDYIDDYSY

SEQ ID NO: 535 - protein, 16 aa, Artificial Sequence
  Description of Artificial Sequence: Synthetic peptide
  Nanobody sequence
RTSYNGIYDYIDDYSY

SEQ ID NO: 536 - protein, 16 aa, Artificial Sequence
  Description of Artificial Sequence: Synthetic peptide
  Nanobody sequence
RTSYSGTYDYIDDYSY

SEQ ID NO: 537 - protein, 16 aa, Artificial Sequence
  Description of Artificial Sequence: Synthetic peptide
  Nanobody sequence
RTSYDGTYDYIDDYSY

SEQ ID NO: 538 - protein, 16 aa, Artificial Sequence
  Description of Artificial Sequence: Synthetic peptide
  Nanobody sequence
RTSYDGTYDYIDDYSY

SEQ ID NO: 539 - protein, 16 aa, Artificial Sequence
  Description of Artificial Sequence: Synthetic peptide
  Nanobody sequence
RTSYDGTYDYIDDYSY

SEQ ID NO: 540 - protein, 16 aa, Artificial Sequence
  Description of Artificial Sequence: Synthetic peptide
  Nanobody sequence
RTSYDGRYDYIDDYSY

SEQ ID NO: 541 - protein, 16 aa, Artificial Sequence
  Description of Artificial Sequence: Synthetic peptide
  Nanobody sequence
RTSYDGRYDYIDDYSD

SEQ ID NO: 542 - protein, 16 aa, Artificial Sequence
  Description of Artificial Sequence: Synthetic peptide
  Nanobody sequence
RTSYSGRYDYIDDYSY

SEQ ID NO: 543 - protein, 16 aa, Artificial Sequence
  Description of Artificial Sequence: Synthetic peptide
  Nanobody sequence
RTSYSGRYDYIDDYSY

SEQ ID NO: 544 - protein, 16 aa, Artificial Sequence
  Description of Artificial Sequence: Synthetic peptide
  Nanobody sequence
RTSYSGMYDYIHDYSY

SEQ ID NO: 545 - protein, 16 aa, Artificial Sequence
  Description of Artificial Sequence: Synthetic peptide
  Nanobody sequence
RTSYNGRYDYIDDYSY

SEQ ID NO: 546 - protein, 16 aa, Artificial Sequence
  Description of Artificial Sequence: Synthetic peptide
  Nanobody sequence
RTSYDGRYDYIDDYSD

SEQ ID NO: 547 - protein, 16 aa, Artificial Sequence
  Description of Artificial Sequence: Synthetic peptide
  Nanobody sequence
RTSYDGTYDYIDDYSY

SEQ ID NO: 548 - protein, 15 aa, Artificial Sequence
  Description of Artificial Sequence: Synthetic peptide
  Nanobody sequence
VMEYGLGCTTDVLDA

SEQ ID NO: 549 - protein, 9 aa, Artificial Sequence
  Description of Artificial Sequence: Synthetic peptide
  Nanobody sequence
DVGGGSDRY

SEQ ID NO: 550 - protein, 9 aa, Artificial Sequence
  Description of Artificial Sequence: Synthetic peptide
  Nanobody sequence
DVGGGSDRY

SEQ ID NO: 551 - protein, 9 aa, Artificial Sequence
  Description of Artificial Sequence: Synthetic peptide
  Nanobody sequence
DVQGGLHRY

SEQ ID NO: 552 - protein, 11 aa, Artificial Sequence
  Description of Artificial Sequence: Synthetic peptide
  Nanobody sequence
WGQGTQVTVSS

SEQ ID NO: 553 - protein, 11 aa, Artificial Sequence
  Description of Artificial Sequence: Synthetic peptide
  Nanobody sequence
WGQGTQVTVSS

SEQ ID NO: 554 - protein, 11 aa, Artificial Sequence
  Description of Artificial Sequence: Synthetic peptide
  Nanobody sequence
RGQGTQVTVSS

SEQ ID NO: 555 - protein, 11 aa, Artificial Sequence
  Description of Artificial Sequence: Synthetic peptide
  Nanobody sequence
WGQGTQVTVSS

SEQ ID NO: 556 - protein, 11 aa, Artificial Sequence
  Description of Artificial Sequence: Synthetic peptide
  Nanobody sequence
WGQGTQVTVSS

SEQ ID NO: 557 - protein, 11 aa, Artificial Sequence
  Description of Artificial Sequence: Synthetic peptide
  Nanobody sequence
WGQGTQVTVSS

SEQ ID NO: 558 - protein, 11 aa, Artificial Sequence
  Description of Artificial Sequence: Synthetic peptide
  Nanobody sequence
WGQGTQVTVSS

SEQ ID NO: 559 - protein, 11 aa, Artificial Sequence
  Description of Artificial Sequence: Synthetic peptide
  Nanobody sequence
WGQGTQVTVSS

SEQ ID NO: 560 - protein, 11 aa, Artificial Sequence
  Description of Artificial Sequence: Synthetic peptide
  Nanobody sequence
WGQGTQVTVSS

SEQ ID NO: 561 - protein, 11 aa, Artificial Sequence
  Description of Artificial Sequence: Synthetic peptide
  Nanobody sequence
WGKGTQVTVSS

SEQ ID NO: 562 - protein, 11 aa, Artificial Sequence
  Description of Artificial Sequence: Synthetic peptide
  Nanobody sequence
WGQGTQVTVSS

SEQ ID NO: 563 - protein, 11 aa, Artificial Sequence
  Description of Artificial Sequence: Synthetic peptide
  Nanobody sequence
WGQGTQVTVSS

SEQ ID NO: 564 - protein, 11 aa, Artificial Sequence
  Description of Artificial Sequence: Synthetic peptide
  Nanobody sequence
WGQGTQVTVSS

SEQ ID NO: 565 - protein, 11 aa, Artificial Sequence
  Description of Artificial Sequence: Synthetic peptide
  Nanobody sequence
WGRGTQVTVSS

SEQ ID NO: 566 - protein, 11 aa, Artificial Sequence
  Description of Artificial Sequence: Synthetic peptide
  Nanobody sequence
WGLGTQVTVSS

SEQ ID NO: 567 - protein, 11 aa, Artificial Sequence
  Description of Artificial Sequence: Synthetic peptide
  Nanobody sequence
WGQGTQVTVSS

SEQ ID NO: 568 - protein, 11 aa, Artificial Sequence
  Description of Artificial Sequence: Synthetic peptide
  Nanobody sequence
WGQGTQVTVSS

SEQ ID NO: 569 - protein, 11 aa, Artificial Sequence
  Description of Artificial Sequence: Synthetic peptide
  Nanobody sequence
WGQGTQVTVSS

SEQ ID NO: 570 - protein, 11 aa, Artificial Sequence
  Description of Artificial Sequence: Synthetic peptide
  Nanobody sequence
WGQGTQVTVSS

SEQ ID NO: 571 - protein, 11 aa, Artificial Sequence
  Description of Artificial Sequence: Synthetic peptide
  Nanobody sequence
WGQGTQVTVSS

SEQ ID NO: 572 - protein, 11 aa, Artificial Sequence
  Description of Artificial Sequence: Synthetic peptide
  Nanobody sequence
WGQGTQVTVSS

SEQ ID NO: 573 - protein, 11 aa, Artificial Sequence
  Description of Artificial Sequence: Synthetic peptide
  Nanobody sequence
WGQGTQVTVSS

SEQ ID NO: 574 - protein, 11 aa, Artificial Sequence
  Description of Artificial Sequence: Synthetic peptide
  Nanobody sequence
WGQGTQVTVSS

SEQ ID NO: 575 - protein, 11 aa, Artificial Sequence
  Description of Artificial Sequence: Synthetic peptide
  Nanobody sequence
WGQGTQVTVSS

SEQ ID NO: 576 - protein, 11 aa, Artificial Sequence
  Description of Artificial Sequence: Synthetic peptide
  Nanobody sequence
GGQGTQVTVSS

SEQ ID NO: 577 - protein, 11 aa, Artificial Sequence
  Description of Artificial Sequence: Synthetic peptide
  Nanobody sequence
WGQGTQVTVSS

SEQ ID NO: 578 - protein, 11 aa, Artificial Sequence
  Description of Artificial Sequence: Synthetic peptide
  Nanobody sequence
WGQGTQVTVSS

SEQ ID NO: 579 - protein, 11 aa, Artificial Sequence
  Description of Artificial Sequence: Synthetic peptide
  Nanobody sequence
WGQGTQVTVSS

SEQ ID NO: 580 - protein, 11 aa, Artificial Sequence
  Description of Artificial Sequence: Synthetic peptide
  Nanobody sequence
GGQGTQVTVSS

SEQ ID NO: 581 - protein, 11 aa, Artificial Sequence
  Description of Artificial Sequence: Synthetic peptide
  Nanobody sequence
GGQGTQVTVSS

SEQ ID NO: 582 - protein, 11 aa, Artificial Sequence
  Description of Artificial Sequence: Synthetic peptide
  Nanobody sequence
GGQGTQVTVSS

SEQ ID NO: 583 - protein, 11 aa, Artificial Sequence
  Description of Artificial Sequence: Synthetic peptide
  Nanobody sequence
GGQGTQVTVSS

SEQ ID NO: 584 - protein, 11 aa, Artificial Sequence
  Description of Artificial Sequence: Synthetic peptide
  Nanobody sequence
GGQGTQVTVSS

SEQ ID NO: 585 - protein, 11 aa, Artificial Sequence
  Description of Artificial Sequence: Synthetic peptide
  Nanobody sequence
GGQGTQVTVSS

SEQ ID NO: 586 - protein, 11 aa, Artificial Sequence
  Description of Artificial Sequence: Synthetic peptide
  Nanobody sequence
WGQGTQVTVSS

SEQ ID NO: 587 - protein, 11 aa, Artificial Sequence
  Description of Artificial Sequence: Synthetic peptide
  Nanobody sequence
WGQGTRVTVSS

SEQ ID NO: 588 - protein, 11 aa, Artificial Sequence
  Description of Artificial Sequence: Synthetic peptide
  Nanobody sequence
WGQGTQVTVSS

SEQ ID NO: 589 - protein, 11 aa, Artificial Sequence
  Description of Artificial Sequence: Synthetic peptide
  Nanobody sequence
WGQGTQVTVSS

SEQ ID NO: 590 - protein, 11 aa, Artificial Sequence
  Description of Artificial Sequence: Synthetic peptide
  Nanobody sequence
WGQGTQVTVSS

SEQ ID NO: 591 - protein, 11 aa, Artificial Sequence
  Description of Artificial Sequence: Synthetic peptide
  Nanobody sequence
WGQGTQVTVSS

SEQ ID NO: 592 - protein, 11 aa, Artificial Sequence
  Description of Artificial Sequence: Synthetic peptide
  Nanobody sequence
WGQGSQVTVSS

SEQ ID NO: 593 - protein, 11 aa, Artificial Sequence
  Description of Artificial Sequence: Synthetic peptide
  Nanobody sequence
WGQGTQVTVSS

SEQ ID NO: 594 - protein, 11 aa, Artificial Sequence
  Description of Artificial Sequence: Synthetic peptide
  Nanobody sequence
WGQGTQVTVSS

SEQ ID NO: 595 - protein, 11 aa, Artificial Sequence
  Description of Artificial Sequence: Synthetic peptide
  Nanobody sequence
WGQGTQVTVSS

SEQ ID NO: 596 - protein, 11 aa, Artificial Sequence
  Description of Artificial Sequence: Synthetic peptide
  Nanobody sequence
WGQGTQVTVSS

SEQ ID NO: 597 - protein, 11 aa, Artificial Sequence
  Description of Artificial Sequence: Synthetic peptide
  Nanobody sequence
WGQGTQVTVSS

SEQ ID NO: 598 - protein, 11 aa, Artificial Sequence
  Description of Artificial Sequence: Synthetic peptide
  Nanobody sequence
WGQGTQVTVSS

SEQ ID NO: 599 - protein, 11 aa, Artificial Sequence
  Description of Artificial Sequence: Synthetic peptide
  Nanobody sequence
WGQGTQVTVSS

SEQ ID NO: 600 - protein, 11 aa, Artificial Sequence
  Description of Artificial Sequence: Synthetic peptide
  Nanobody sequence
WGQGTQVTVSS

SEQ ID NO: 601 - protein, 11 aa, Artificial Sequence
  Description of Artificial Sequence: Synthetic peptide
  Nanobody sequence
WGQGTQVTVSS

SEQ ID NO: 602 - protein, 11 aa, Artificial Sequence
  Description of Artificial Sequence: Synthetic peptide
  Nanobody sequence
WGQGTQVTVSS

SEQ ID NO: 603 - protein, 11 aa, Artificial Sequence
  Description of Artificial Sequence: Synthetic peptide
  Nanobody sequence
WGQGTQVTVSS

SEQ ID NO: 604 - protein, 11 aa, Artificial Sequence
  Description of Artificial Sequence: Synthetic peptide
  Nanobody sequence
WGQGTQVTVSS

SEQ ID NO: 605 - protein, 11 aa, Artificial Sequence
  Description of Artificial Sequence: Synthetic peptide
  Nanobody sequence
WGQGTQVTVSS

SEQ ID NO: 606 - protein, 11 aa, Artificial Sequence
  Description of Artificial Sequence: Synthetic peptide
  Nanobody sequence
WGQGTQVTVSS

SEQ ID NO: 607 - protein, 11 aa, Artificial Sequence
  Description of Artificial Sequence: Synthetic peptide
  Nanobody sequence
WGQGTQVTVSS

SEQ ID NO: 608 - protein, 11 aa, Artificial Sequence
  Description of Artificial Sequence: Synthetic peptide
  Nanobody sequence
WGQGTQVTVSS

SEQ ID NO: 609 - protein, 11 aa, Artificial Sequence
  Description of Artificial Sequence: Synthetic peptide
  Nanobody sequence
WGQGTQVTVSS

SEQ ID NO: 610 - protein, 11 aa, Artificial Sequence
  Description of Artificial Sequence: Synthetic peptide
  Nanobody sequence
WGQGTQVTVSS

SEQ ID NO: 611 - protein, 11 aa, Artificial Sequence
  Description of Artificial Sequence: Synthetic peptide
  Nanobody sequence
WGQGTQVTVSS

SEQ ID NO: 612 - protein, 11 aa, Artificial Sequence
  Description of Artificial Sequence: Synthetic peptide
  Nanobody sequence
WGQGTQVTVSS

SEQ ID NO: 613 - protein, 11 aa, Artificial Sequence
  Description of Artificial Sequence: Synthetic peptide
  Nanobody sequence
WGQGTQVTVSS

SEQ ID NO: 614 - protein, 11 aa, Artificial Sequence
  Description of Artificial Sequence: Synthetic peptide
  Nanobody sequence
WGQGTQVTVSS

SEQ ID NO: 615 - protein, 11 aa, Artificial Sequence
  Description of Artificial Sequence: Synthetic peptide
  Nanobody sequence
WGQGTQVTVSS

SEQ ID NO: 616 - protein, 11 aa, Artificial Sequence
  Description of Artificial Sequence: Synthetic peptide
  Nanobody sequence
WGQGTQVTVSS

SEQ ID NO: 617 - protein, 11 aa, Artificial Sequence
  Description of Artificial Sequence: Synthetic peptide
  Nanobody sequence
WGQGTQVTVSS

SEQ ID NO: 618 - protein, 11 aa, Artificial Sequence
  Description of Artificial Sequence: Synthetic peptide
  Nanobody sequence
WGQGTQVTVSS

SEQ ID NO: 619 - protein, 11 aa, Artificial Sequence
  Description of Artificial Sequence: Synthetic peptide
  Nanobody sequence
WGQGTLVTVSS

SEQ ID NO: 620 - protein, 11 aa, Artificial Sequence
  Description of Artificial Sequence: Synthetic peptide
  Nanobody sequence
LGQGTQVTVSS

SEQ ID NO: 621 - protein, 11 aa, Artificial Sequence
  Description of Artificial Sequence: Synthetic peptide
  Nanobody sequence
LGQGTQVTVSS

SEQ ID NO: 622 - protein, 11 aa, Artificial Sequence
  Description of Artificial Sequence: Synthetic peptide
  Nanobody sequence
WGQGTQVTVSS

SEQ ID NO: 623 - protein, 125 aa, Artificial Sequence
  Description of Artificial Sequence: Synthetic polypeptide
  Nanobody sequence
EVQLVESGGGLVQAGGSLRLSCAASGLSFSSYALGWFRQAPGKERDFVAAINWSGDNTHYADSVKGRFTISRDNAKNTVSLQMNSLKPEDTAVYYCAAQLGYESGYSLTYDYDYWGQGTQVTVSS

SEQ ID NO: 624 - protein, 120 aa, Artificial Sequence
  Description of Artificial Sequence: Synthetic polypeptide
  Nanobody sequence
EVQLVESGGGLVQAGGSLRLSCAASERTISNYDMGWFRQAPGKERELIAADISWSALNTNYADSVKGRFTISRDNAKNMVYLQMNNLKPEDTAVYYCAARRSGYASFDNWGQGTQVTVSS

SEQ ID NO: 625 - protein, 128 aa, Artificial Sequence
  Description of Artificial Sequence: Synthetic polypeptide
  Nanobody sequence
EVQLVESGGGLVQPGGSLRLSCAASGFTFSSYAMSWARQAPGEGLEWVSDINSGGTRTTYADSVKGRFTISRDNAKNTLYLQMNSLKPEDTAVYVCAKLSVFRSQLGGKYYGGDYENRGQGTQVTVSS

SEQ ID NO: 626 - protein, 124 aa, Artificial Sequence
  Description of Artificial Sequence: Synthetic polypeptide
  Nanobody sequence
EVQLVESGGGLVQAGGSLRLSCAASGFTFDDYAIGWFRQAPGKEREGVSCISSSDGSIYYADSVKGRFTISSDNAKNTVYLQMNSLKPEDTAVYHCARFGRTGWAEECVDYDYWGQGTQVTVSS

SEQ ID NO: 627 - protein, 120 aa, Artificial Sequence
  Description of Artificial Sequence: Synthetic polypeptide
  Nanobody sequence
EVQLVESGGGLVQAGGSLRLSCAASGVTFDDYSIGWFRQAPGKEREGVSCISSSDGIPYYSDFVKGRFTTSIDNAKNTVYLQMNSLKPEDTAVYYCAAGFGRLCAEFDSWGQGTQVTVSS

SEQ ID NO: 628 - protein, 123 aa, Artificial Sequence
  Description of Artificial Sequence: Synthetic polypeptide
  Nanobody sequence
EVQLVESGGGLVQAGGSLRLSCAADGRTFSTYGMTWFRQVPGKEREFVAHIPRSTYSPYYANSVKGRFTIARDDAKSTVYLQMNSLKPEDTAVYYCAVFTGGTYYVPTAYDYWGQGTQVTVSS

SEQ ID NO: 629 - protein, 125 aa, Artificial Sequence
  Description of Artificial Sequence: Synthetic polypeptide
  Nanobody sequence
EVQLVESGGGVVQPGGSLRLSCADSERSFSFNAMGWFRQAPGKEREFVAAISATGDDTYYADSVKGRFAISRDTARNTVYLQMNSLKPEDTAVYYCGARVNFDGTVSYTNDYAYWGQGTQVTVSS

SEQ ID NO: 630 - protein, 117 aa, Artificial Sequence
  Description of Artificial Sequence: Synthetic polypeptide
  Nanobody sequence
EVQLVESGGGLVQPGGSLRLSCAASGFALGYYAIGWFRQAPGKEREGVSCDSSSDGRTYYGDSVKGRFTISTDSAKNTVYLQMNSLKPEDTAVYYCATCTDFEYDYWGQGTQVTVSS

SEQ ID NO: 631 - protein, 117 aa, Artificial Sequence
  Description of Artificial Sequence: Synthetic polypeptide
  Nanobody sequence
EVQLVESGGGLVQPGGSLRLSCAASGFTLGYYAIGWFRQAPGKEREGVSCDSSSDGDTYYANSVKGRFTISTDNGKNTVYLQMNSLKPEDTAVYYCATCTDWNYDYWGQGTQVTVSS

SEQ ID NO: 632 - protein, 127 aa, Artificial Sequence
  Description of Artificial Sequence: Synthetic polypeptide
  Nanobody sequence
EVQLVESGGGLVQAGGSLRLSCAASGFTFDDYAIGWFRQAPGKEREAVSCFSSSDGSIYYADSVKGRFTISSDNAKNTVYLQMNSLKPEDTAVYYCAGGGGSYYYTQLNYCYDMDYWGKGTQVTVSS

SEQ ID NO: 633 - protein, 123 aa, Artificial Sequence
  Description of Artificial Sequence: Synthetic polypeptide
  Nanobody sequence
EVQLVESGGGLVQPGGSLRLSCAASRNINIINYMAWYRQAPGNQRELVAAMTSDATTEYADSVKGRFTISRDIPENTVYLQMNSLKPEDTAVYYCNAKGIWDYLGRRDFGDYWGQGTQVTVSS

SEQ ID NO: 634 - protein, 124 aa, Artificial Sequence
  Description of Artificial Sequence: Synthetic polypeptide
  Nanobody sequence
EVQLVESGGGLVQAGGSQSLSCVASGTIVNINVMGWYRQAPGKQRELVALITSGGGTTYGDSVKGRFTISIDNAKNTVILQMNSLEAEDTAVYYCAAEIGYYSGGTYFSSEAHWGQGTQVTVSS

SEQ ID NO: 635 - protein, 124 aa, Artificial Sequence
  Description of Artificial Sequence: Synthetic polypeptide
  Nanobody sequence
EVQLVESGGGLVQAGGSQRLSCTASGTIVNIHVMGWYRQAPGKQRELVALIFSGGSADYADSVKGRFTISRDNAKNTVYLEMNSLKAEDTAVYYCAAEIGYYSGGTYYSSEAHWGQGTQVTVSS

SEQ ID NO: 636 - protein, 120 aa, Artificial Sequence
  Description of Artificial Sequence: Synthetic polypeptide
  Nanobody sequence
EVQLVESGGGLVQPGGSLRLSCAASGRTFSTHAMGWFRQAPGKERDFVAAIRWSDGSSFYADSVKGRFTISRDNAKNAVYLQSNSLKSEDTAVYVCYADVEGPTALHKYWGRGTQVTVSS

SEQ ID NO: 637 - protein, 117 aa, Artificial Sequence
  Description of Artificial Sequence: Synthetic polypeptide
  Nanobody sequence
EVQLVESGGGLVQAGGSLSLSCAASGSVFRIDVMRWHRQAPGKQREFLASIASGGTTNYADSVKGRFTISRDNAKNTVYLQMNSLKPEDTAVYYCGANAESGPYTYWGLGTQVTVSS

SEQ ID NO: 638 - protein, 116 aa, Artificial Sequence
  Description of Artificial Sequence: Synthetic polypeptide
  Nanobody sequence
EVQLVESGGGLVQAGGSLRLSCAASDSVFTAKAVGWYRQPPGLQREWVAIITSGGKTNYADSSVKGRFTVSVDKVKNTVTLQMNSLKPEDTAVYYCYAQWMGRDYWGQGTQVTVSS

SEQ ID NO: 639 - protein, 123 aa, Artificial Sequence
  Description of Artificial Sequence: Synthetic polypeptide
  Nanobody sequence
EVQLVESGGGLVQPGESLRLSCKASGFSLDYYALGWFRQAPGKEREGISCITSSDASAYYTDSVKGRFTISRDNSKNTVYLQMNSLKTEDTAIYYCAAALLTCSSYYDAYTYWGQGTQVTVSS

SEQ ID NO: 640 - protein, 119 aa, Artificial Sequence
  Description of Artificial Sequence: Synthetic polypeptide
  Nanobody sequence
EVQLVESGGGLVQAGGSLRLSCPVSGRAFSRGRLGWFRQAPGKEREFVAVAHWSGAITSYADSVKGRFTFSRDNAKNTMNLQMNSLKPEDTAVYYCAADSETSGNWVYWGQGTQVTVSS

SEQ ID NO: 641 - protein, 118 aa, Artificial Sequence
  Description of Artificial Sequence: Synthetic polypeptide
  Nanobody sequence
EVQLVESGGGLVQAGGSLRLSCGASGGTFSSYATGWFRQAPGKEREFVAVLRWSDGHTAYADSVKGRFTISRDGAKNTMYLQMSSLKPEDTAIYYCTTATRPGEWDYWGQGTQVTVSS

SEQ ID NO: 642 - protein, 118 aa, Artificial Sequence
  Description of Artificial Sequence: Synthetic polypeptide
  Nanobody sequence
EVQLVESGGGLVQAGGSLRLSCGAAGGTFSSYATGWFRQAPGKEREFVAVFRWSDSHTAYADSVKGRFTISRDGAKNTLYLQMSSLKPEDTAIYYCTTATRPGEWDYWGQGTQVTVSS

SEQ ID NO: 643 - protein, 118 aa, Artificial Sequence
  Description of Artificial Sequence: Synthetic polypeptide
  Nanobody sequence
EVQLVESGGGLVQAGGSLRLSCVASGRAFSSYVMGWFRQAPGMEREFVALIRWSDGITGYVDSVKGRFTISRDNAKNTVYLQMNSLKPEDTAVYYCAAAVRPGDYDYWGQGTQVTVSS

SEQ ID NO: 644 - protein, 119 aa, Artificial Sequence
  Description of Artificial Sequence: Synthetic polypeptide
  Nanobody sequence
EVQLVESGGGLVQAGGSLRLSCAASGRTFRPYRMGWFRRAPGKAREFVTLISWSSGRTSYADSVKGRFTISRDSAKNAVYLQMDNLKPEDTAVYFCAVDLSGDAVYDSWGQGTQVTVSS

SEQ ID NO: 645 - protein, 123 aa, Artificial Sequence
  Description of Artificial Sequence: Synthetic polypeptide
  Nanobody sequence
EVQLVESGGGLVQPGGSLRLSCAASGRDFRVKNVGWIRQAPGKQRELVATITVGGSTNYADSAKGRFTISRDNAKNTVYLQMSSLKPEDTAVYYCNAVATVTDYTGTYSDGFWGQGTQVTVSS

SEQ ID NO: 646 - protein, 118 aa, Artificial Sequence
  Description of Artificial Sequence: Synthetic polypeptide
  Nanobody sequence
EVQLVESGGGLVQAGGSLRLSCGASGGTFSSYATGWFRQAPGKEREFVAVLRWSDSHTAYADSVEGRFTISRDGAKNTVYLQMSSLKPEDTAIYYCTTGTRPGEWHYWGQGTQVTVSS

SEQ ID NO: 647 - protein, 118 aa, Artificial Sequence
  Description of Artificial Sequence: Synthetic polypeptide
  Nanobody sequence
EVQLVESGGGLVQPGGSLRLSCAASGFTFSSYRMAWVRQAPGKGLEWVSSTSTGGEMTNYADSVKGRFTISRDNAKNTLHLQMNSLKPEDTALYYCAAGTSAGHWSTGGQGTQVTVSS

SEQ ID NO: 648 - protein, 123 aa, Artificial Sequence
  Description of Artificial Sequence: Synthetic polypeptide
  Nanobody sequence
EVQLVESGGGLVQAGGSLRLSCAASGRTFSSYVVGWFRQAPGKEREFIGAISGSGDSIYYAVSEKDRFTISRDNGKNTLYLQMSSLKAEDTAVYYCTADQEFGYLRFGRSEYWGQGTQVTVSS

SEQ ID NO: 649 - protein, 119 aa, Artificial Sequence
  Description of Artificial Sequence: Synthetic polypeptide
  Nanobody sequence
EVQLVESGGGLVQAGGSLRLSCAVSGGTFSTYKMGWFRQAPGKEREIVARISTNGPTAYAEFVKGRFTVSRENTKNTVYLQMNSLNIEDTAVYYCAAGYDSLFAGYDYWGQGTQVTVSS

SEQ ID NO: 650 - protein, 128 aa, Artificial Sequence
  Description of Artificial Sequence: Synthetic polypeptide
  Nanobody sequence
EVQLVESGGGLVQAGGSLRLSCAASGFTFDDYDIGWFRQAPGKEREGVSCFTSSDGRTFYADSVKGRFTVSADNAKNTVYLQMNSLEPEDTAVYFCAAVNTFDESAYAAFACYDVVRWGQGTQVTVSS

SEQ ID NO: 651 - protein, 122 aa, Artificial Sequence
  Description of Artificial Sequence: Synthetic polypeptide
  Nanobody sequence
EMQLVESGGGLVQPGGSLRLSCAASGFTFSSYWMYWARQAPGKGLEWISALAPGGDDEYYADSVNGRFTISRDNAENSLYLQMNSLKSEDTAVYYCAKDHNVGYRTGEYDYGGQGTQVTVSS

SEQ ID NO: 652 - protein, 122 aa, Artificial Sequence
  Description of Artificial Sequence: Synthetic polypeptide
  Nanobody sequence
EVQLVESGGGLVQPGGSLRLSCAASGFTFSSYWMYWVRQAPGKGLEWISALAPGGDNRYYADSVNGRFTISRDNAENSLYLQMNSLKSEDTAVYYCAKDHNVGYRTGEYDYGGQGTQVTVSS

SEQ ID NO: 653 - protein, 122 aa, Artificial Sequence
  Description of Artificial Sequence: Synthetic polypeptide
  Nanobody sequence
EVQLVESGGGLVQPGGSLRLSCAASGFTFSSYWMYWVRQAPGKGLEWISALAPGGGNRYYAESVNGRFTISRDNAKNSLYLQMNSLKSEDTAVYYCAKDHNVGYRTGEYDYGGQGTQVTVSS

SEQ ID NO: 654 - protein, 122 aa, Artificial Sequence
  Description of Artificial Sequence: Synthetic polypeptide
  Nanobody sequence
EVQLVESGGGLVQPGGSLRLSCAASGFTFSNYWMYWVRQAPGKGLEWISALAPGGDNRYYADSVNGRFTISRDNAENSLYLQMNSLKSEDTAVYYCAKDHNVGYRTGEYDYGGQGTQVTVSS

SEQ ID NO: 655 - protein, 122 aa, Artificial Sequence
  Description of Artificial Sequence: Synthetic polypeptide
  Nanobody sequence
EVQLVESGGGLVQAGGSLRLSCAASGFTFSSYWMYWVRQAPGKGLEWISALAPGGEHRYYADSVNGRFTISRDNAKNSLYLQMNSLKSEDTAVYYCAKDHNVGYRTGEYDYGGQGTQVTVSS

SEQ ID NO: 656 - protein, 122 aa, Artificial Sequence
  Description of Artificial Sequence: Synthetic polypeptide
  Nanobody sequence
EVQLVESGGGLVQPGGSLRLSCAASGFTFSSYWMYWVRQAPGKGLEWISALAPGGGNAYYADSVNGRFTISRDNAENLLYLQMNSLKSEDTAVYYCAKDHNVGYRTGEYDYGGQGTQVTVSS

SEQ ID NO: 657 - protein, 115 aa, Artificial Sequence
  Description of Artificial Sequence: Synthetic polypeptide
  Nanobody sequence
EVQLVESGGGLVQAGGSLRLSCAASGVIFRLNAMGWYRAAPGKQRELVAIIINGGSTNYADSVKGRFTISRDSAKNAVYLQMNSLKPEDTAVYYCYYNIPGDVYWGQGTQVTVSS

SEQ ID NO: 658 - protein, 115 aa, Artificial Sequence
  Description of Artificial Sequence: Synthetic polypeptide
  Nanobody sequence
EVQLVESGGGLVQAGGSLRLSCAAPGVIFRLNAMGWYRAAPGKQRELVAIIANGGSTNYADSVKGRFTISRDSAKNAVYLQMNSLKPEDTAVYYCYYNIPGDVYWGQGTRVTVSS

SEQ ID NO: 659 - protein, 115 aa, Artificial Sequence
  Description of Artificial Sequence: Synthetic polypeptide
  Nanobody sequence
EVQLVESGGGLVQAGGSLRLSCAASGVIFRLNAMGWYRAAPGKQRELVAIIVNGGSTNYADSVKGRFTISRDSAKNAVYLQMNSLKPEDTAVYYCYYNIPGDVYWGQGTQVTVSS

SEQ ID NO: 660 - protein, 115 aa, Artificial Sequence
  Description of Artificial Sequence: Synthetic polypeptide
  Nanobody sequence
EVQLVESGGGLVQAGGSLRLSCAASGVIFRLNAMGWYRAAPGKQRELVAIIVNGGSTNYADSVKGRFTISRDSAKNAVYLQMDSLKPEDTAVYYCYYNIPGDVYWGQGTQVTVSS

SEQ ID NO: 661 - protein, 115 aa, Artificial Sequence
  Description of Artificial Sequence: Synthetic polypeptide
  Nanobody sequence
EVQLVESGGGLVQPGGSLRLSCAASGVIFRLNAMGWYRAAPGKQRELVAIIVNGGSTNYADSVKGRFTISRDNAKNAVYLQMNSLKPEDTAVYYCYYNIPGDVYWGQGTQVTVSS

SEQ ID NO: 662 - protein, 116 aa, Artificial Sequence
  Description of Artificial Sequence: Synthetic polypeptide
  Nanobody sequence
EVQLVESGGGSVQAGDSLRLSCAASGRANSINWFGWFRQTPGKEREFVAGIRWSDAYTEYANSVKGRFTISRDNAKNTVDLQMDSLKPEDTAVYYCVLDLSTVRYWGQGTQVTVSS

SEQ ID NO: 663 - protein, 116 aa, Artificial Sequence
  Description of Artificial Sequence: Synthetic polypeptide
  Nanobody sequence
EVQLVESGGGSVQAGDSLRLSCAASGRANSINWFGWFRQTPGKEREFVAGIRWTDAYTEYAASVKGRFTISRDNAKNTVGLQMDSLKPEDTAVYYCVLDLSTVRYWGQGSQVTVSS

SEQ ID NO: 664 - protein, 122 aa, Artificial Sequence
  Description of Artificial Sequence: Synthetic polypeptide
  Nanobody sequence
EVQLVESGGGLVQAGGSLRLSCAASGRTYDAMGWLRQAPGKEREFVAAISGSGDDTYYADSVKGRFTISKDNAGITMYLQMNSLKPEDTAVYYCATRRGLYYVWDSNDYENWGQGTQVTVSS

SEQ ID NO: 665 - protein, 122 aa, Artificial Sequence
  Description of Artificial Sequence: Synthetic polypeptide
  Nanobody sequence
EVQLVESGGGLVQAGGSLRLSCAASGRTYYAMGWLRQAPGKEREFVAAISGSGDDTYYADSVKGRFTISKDNAGITMYLEMNSLKPEDTAVYYCATRRGRYYVWDSNDYENWGQGTQVTVSS

SEQ ID NO: 666 - protein, 122 aa, Artificial Sequence
  Description of Artificial Sequence: Synthetic polypeptide
  Nanobody sequence
EVQLVESGGGLVQAGGSLRLSCAASGRTYYAMGWLRQAPGKEREFVAAISGSGDDTYYADSVKGRFTISKDNAGITMYLQMNSLKPEDTAVYYCATRRGLYYVWDSNDYENWGQGTQVTVSS

SEQ ID NO: 667 - protein, 122 aa, Artificial Sequence
  Description of Artificial Sequence: Synthetic polypeptide
  Nanobody sequence
EVQLVESGGGLVQAGGSLRLSCAASGRTYHAMGWLRQAPGKEREFVAAVSGSGDDTYYADSVKGRFTISKDNAGITMYLQMNSLKPEDTAVYYCATRRGLYYVWDSNDYENWGQGTQVTVSS

SEQ ID NO: 668 - protein, 122 aa, Artificial Sequence
  Description of Artificial Sequence: Synthetic polypeptide
  Nanobody sequence
EVQLVESGGGLVQAGGSLRLSCAASGRTYDAMGWFRQAPGKEREFVAAISGSGEDTYYADSVKGRFTCSKDNAKDTMYLQMNSLKPEDTAVYYCATRRGLYFITDSNDYENWGQGTQVTVSS

SEQ ID NO: 669 - protein, 119 aa, Artificial Sequence
  Description of Artificial Sequence: Synthetic polypeptide
  Nanobody sequence
EVQLVESGGGKVQAGDSLTLSCVASGGTFSNYAAWFRQAPGKDRRELVVSIFRTGSITYTADSVKGRFTASRVNTKNTVYLQMNSLKPEDTAVYYCASAYNPGVGYDYWGQGTQVTVSS

SEQ ID NO: 670 - protein, 118 aa, Artificial Sequence
  Description of Artificial Sequence: Synthetic polypeptide
  Nanobody sequence
EVQLVESGGGLVQAGGSLRLSCEASGGTFSNYAAWFRQGPGKGRELVVSIFRSGTITYTADSVKGRFTASRVNTKNTVYLQMNSLKPEDTGIYYCASAYNPGIGYDYWGQGTQVTVSS

SEQ ID NO: 671 - protein, 119 aa, Artificial Sequence
  Description of Artificial Sequence: Synthetic polypeptide
  Nanobody sequence
EVQLVESGGGLVQAGDSLTLSCVASGGTFSNYAAWFRQAPGKDRRELVVSIFRTGSITYTADSVKGRFTASRVNTKNTVYLQMNSLKPEDTAVYYCASAYNPGVGYDYWGQGTQVTVSS

SEQ ID NO: 672 - protein, 118 aa, Artificial Sequence
  Description of Artificial Sequence: Synthetic polypeptide
  Nanobody sequence
EVQLVESGGGLVQAGDSLRLSCEASGGTFSNYAAWFRQGPGKGRELVVSIFRSGTITYTADSVKGRFTASRVNTKNTVYLQMNSLKPEDTGIYYCASAYNPGIGYDYWGQGTQVTVSS

SEQ ID NO: 673 - protein, 118 aa, Artificial Sequence
  Description of Artificial Sequence: Synthetic polypeptide
  Nanobody sequence
EVQLVESGGGLVQPGGSLRLSCEASGGTFSNYAAWFRQGPGKGRELVVSIFRSGTITYTADSVKGRFTASRVNTKNTVYLQMNSLKPEDTGIYYCASAYNPGIGYDYWGQGTQVTVSS

SEQ ID NO: 674 - protein, 118 aa, Artificial Sequence
  Description of Artificial Sequence: Synthetic polypeptide
  Nanobody sequence
EVQLVESGGGLVQAGDSLRLSCVASGGTFSNYAAWFRQAPGKGRELILSIFRSGSITYTADSVKGRFTGSRVNTKNTAYLQMNNLKPEDTAVYYCASAYNPGIGYDYWGQGTQVTVSS

SEQ ID NO: 675 - protein, 119 aa, Artificial Sequence; identical to SEQ ID NO: 671
  Description of Artificial Sequence: Synthetic polypeptide
  Nanobody sequence

SEQ ID NO: 676 - protein, 125 aa, Artificial Sequence
  Description of Artificial Sequence: Synthetic polypeptide
  Nanobody sequence
EVQLVKSGGGLVQAGGSLKLSCAASGRTFTTYPMGWFRQAPGKEREFVGAISMSGEDTIYATSVKGRFTISRDDARNTVTLHMTSLKPEDTAVYYCAARTSYNGRYDYIDDYSYWGQGTQVTVSS

SEQ ID NO: 677 - protein, 125 aa, Artificial Sequence
  Description of Artificial Sequence: Synthetic polypeptide
  Nanobody sequence
EVQLVESGGGLVQAGGSLRLSCAASGRTFTTYPMGWFRQAPGKEREFVAAISMSGEDAAYATSVKGRFTISRDNARNTVYLHMTTLKPEDTAVYYCAARTSYNGIYDYIDDYSYWGQGTQVTVSS

SEQ ID NO: 678 - protein, 125 aa, Artificial Sequence
  Description of Artificial Sequence: Synthetic polypeptide
  Nanobody sequence
EVQLVESGGGLVQAGGSLKLSCARSGRTFTTYPMGWFRQAPGKEREFVAAISMSGDDTAYATFVKGRFTIVRDDDKNTVYLHMTSLKPEDTAVYYCAARTSYSGTYDYIDDYSYWGQGTQVTVSS

SEQ ID NO: 679 - protein, 125 aa, Artificial Sequence
  Description of Artificial Sequence: Synthetic polypeptide
  Nanobody sequence
EVQLVESRGRLVQAGGSLRLSCAASGRTFTSYPMGWFRQAPGKEREFVAAISMSGDDAAYADFVRGRFTISRDDARNTVYLHMTSLKPEDTAVYYCAARTSYDGTYDYIDDYSYWGQGTQVTVSS

SEQ ID NO: 680 - protein, 125 aa, Artificial Sequence
  Description of Artificial Sequence: Synthetic polypeptide
  Nanobody sequence
EVQLVESGGRLVQAGGSLRLSCAASGRTFTSYPMGWFRQAPGKEREFVAAISMSGDDTAYTDFVRGRFTISRDDARNTVYLHMTSLKPEDTAVYYCAARTSYDGTYDYIDDYSYWGQGTQVTVSS

SEQ ID NO: 681 - protein, 125 aa, Artificial Sequence
  Description of Artificial Sequence: Synthetic polypeptide
  Nanobody sequence
EVQLVESGGRLVQAGGSLRLSCAASGRTFTSYPMGWFRQAPGKEREFVAAISMSGDDAAYADFVRGRFTISRDDARNTVYLHMTSLKPEDTAVYYCAARTSYDGTYDYIDDYSYWGQGTQVTVSS

SEQ ID NO: 682 - protein, 125 aa, Artificial Sequence
  Description of Artificial Sequence: Synthetic polypeptide
  Nanobody sequence
EVQLVESEGGLVQAGGSLRLSCARSGHAFTSYPMGWFRQAPGKEREFVAAISMSGDDTIYRDFVKGRFTISRDNARNTVYLHMTSLKPEDTAVYYCAARTSYDGRYDYIDDYSYWGQGTQVTVSS

SEQ ID NO: 683 - protein, 125 aa, Artificial Sequence
  Description of Artificial Sequence: Synthetic polypeptide
  Nanobody sequence
EVQLVESGGGLVQAGGSLRLSCAASGRTFTTYPMGWFRQAPGKEREFVAAISMSGDDTAYATFVKGRFTISRDSARNTVYLHMTRLKPEDTAVYSCAARTSYDGRYDYIDDYSDWGQGTQVTVSS

SEQ ID NO: 684 - protein, 125 aa, Artificial Sequence
  Description of Artificial Sequence: Synthetic polypeptide
  Nanobody sequence
EVQLVESRGGLVQAGGSLRLSCAGSGRTLYSYPMGWFRQAPGKEREFVAAISMSGDDTAVATFVKGRFTISRDNARNTVYLHMTSLKPEDTAVYHCAARTSYSGRYDYIDDYSYWGQGTQVTVSS

SEQ ID NO: 685 - protein, 125 aa, Artificial Sequence
  Description of Artificial Sequence: Synthetic polypeptide
  Nanobody sequence
EVQLVESGGGLVQAGGSLRLSCAASGRTLYSYPMGWFRQAPGKEREFVAAISMSGDDTAVATFVKGRFTISRDNARNTVYLHMSSLKPEDTAVYHCAARTSYSGRYDYIDDYSYWGQGTQVTVSS

SEQ ID NO: 686 - protein, 125 aa, Artificial Sequence
  Description of Artificial Sequence: Synthetic polypeptide
  Nanobody sequence
EVQLVESGGGLVQAGGSLELSCARSGRTFTTYPMGWFRQAPGKEREFVAAISMSGDDTAYATFVKGRFTFSRDDDKNTVYLHMTSLKPEDTAVYYCAARTSYSGMYDYIHDYSYWGQGTQVTVSS

SEQ ID NO: 687 - protein, 125 aa, Artificial Sequence
  Description of Artificial Sequence: Synthetic polypeptide
  Nanobody sequence
EVQLVESGGGLVQAGGSLRLSCAASGRTFFSYPMGWFRQAPGKEREFVAAISMSGDDSAYRDFVKGRFTISRDNARDTVYLHMTSLKPEDTAIYYCAARTSYNGRYDYIDDYSYWGQGTQVTVSS

SEQ ID NO: 688 - protein, 125 aa, Artificial Sequence
  Description of Artificial Sequence: Synthetic polypeptide
  Nanobody sequence
EVQLVESGGGLVQAGGSLRLSCAASGRTFTTYPMGWFRQAPGKEREFVAAISMSGDDTAYATFVKGRFTISRDNARNTVYLHMTRLKPEDTAVYSCAARTSYDGRYDYIDDYSDWGQGTQVTVSS

SEQ ID NO: 689 - protein, 125 aa, Artificial Sequence
  Description of Artificial Sequence: Synthetic polypeptide
  Nanobody sequence
EVQLVESGGRLVQAGGSLRLPCAASGRTFTSYPMGWFRQAPGKEREFVAAISMSGDDAAYADFVRGRFTISRDDARNTVYLHMTSLKPEDTAVYYCAARTSYDGTYDYIDDYSYWGQGTQVTVSS

SEQ ID NO: 690 - protein, 124 aa, Artificial Sequence
  Description of Artificial Sequence: Synthetic polypeptide
  Nanobody sequence
EVQLVESGGGLVQPGGSLRLSCAASGFTLDYYAIGWFRQAPGKEREGVSCVSSSDGRTAYADSVKGRFTISRDNAKNTVYLQMNSLKPEDTAVYYCATVMEYGLGCTTDVLDAWGQGTLVTVSS

SEQ ID NO: 691 - protein, 118 aa, Artificial Sequence
  Description of Artificial Sequence: Synthetic polypeptide
  Nanobody sequence
EVQLVESRGGLVQAGGSLRLSCAASGGTFSVFAMRWFRQAPGKEREFVAGISWTGGTTYYADSVKGRFTMSADNAKNTVYLQMNSLKPEDTAVYYCAVDVGGGSDRYLGQGTQVTVSS

SEQ ID NO: 692 - protein, 118 aa, Artificial Sequence; identical to SEQ ID NO: 691
  Description of Artificial Sequence: Synthetic polypeptide
  Nanobody sequence

SEQ ID NO: 693 - protein, 118 aa, Artificial Sequence
  Description of Artificial Sequence: Synthetic polypeptide
  Nanobody sequence
EVQLVKSGGGLVQPGGSLRLSCAASGGTFSLFAMGWFREAPGKEREFVAAIRWSDGSSYYADSVKGRFTISRDNAKNAVHLQSNSLKSEDTAVYYCYADVQGGLHRYWGQGTQVTVSS

SEQ ID NO: 694 - protein, 138 aa, Artificial Sequence
  Description of Artificial Sequence: Synthetic polypeptide
  Human IL-17A-6His
GITIPRNPGCPNSEDKNFPRTVMVNLNIHNRNTNTNPKRSSDYYNRSTSPWNLHRNEDPERYPSVIWEAKCRHLGCINADGNVDYHMNSVPIQQEILVLRREPPHCPNSFRLEKILVSVGCTCVTPIVHHVAHHHHHH

SEQ ID NO: 695 - protein, 139 aa, Artificial Sequence
  Description of Artificial Sequence: Synthetic polypeptide
  Human IL-17F-6His
RKIPKVGHTFFQKPESCPPVPGGSMKLDIGIINENQRVSMSRNIESRSTSPWNYTVTWDPNRYPSEVVQAQCRNLGCINAQGKEDISMNSVPIQQETLVVRRKHQGCSVSFQLEKVLVTVGCTCVTPVIHHVQHHHHHH

SEQ ID NO: 696 - protein, 138 aa, Artificial Sequence
  Description of Artificial Sequence: Synthetic polypeptide
  Cynomolgus IL-17A-6His
GIAIPRNSGCPNSEDKNFPRTVMVNLNIHNRNTSTNPKRSSDYYNRSTSPWNLHRNEDPERYPSVIWEAKCRHLGCVKADGNVDYHMNSVPIQQEILVLRREPRHCPNSFRLEKILVSVGCTCVTPIVHHVAHHHHHH

SEQ ID NO: 697 - protein, 139 aa, Artificial Sequence
  Description of Artificial Sequence: Synthetic polypeptide
  Cynomolgus IL-17F-6His
RKIPKVGHTFFQKPESCPPVPEGSMKLDTGIINENQRVSMSRNIESRSTSPWNYTVTWDPNRYPSEVVQAQCKHLGCINAQGKEDISMNSVPIQQETLVLRRKHQGCSVSFQLEKVLVTVGCTCVTPVIHHVQHHHHHH

SEQ ID NO: 698 - protein, 133 aa, Artificial Sequence
  Description of Artificial Sequence: Synthetic polypeptide
  Marmoset IL-17A-6His
SPQNPGCPNAEDKNFPRTVMVNLNIRNRNTNSKRASDYYNRSSSPWNLHRNEDPERYPSVIWEAKCRHLGCVDADGNVDYHMNSVPIQQEILVLRREPRHCTNSFRLEKMLVSVGCTCVTPIVRHVAHHHHHH

SEQ ID NO: 699 - protein, 138 aa, Artificial Sequence
  Description of Artificial Sequence: Synthetic polypeptide
  Marmoset IL-17F-6His
QRVPKEGQTFFQKPESCPSVPEGSLKLDLGIINANQRVPLSRNIERRSTSPWNYTVTWDPNRYPSEVVQAQCRHLGCVNAQGKEDIFMNSVPIQQETLVLRRKHQGCSVSFQLEKLLVTVGCTCVKPLIHHVHHHHHH

SEQ ID NO: 700 - protein, 140 aa, Artificial Sequence
  Description of Artificial Sequence: Synthetic polypeptide
  Guinea pig IL-17A-6His
GIPIPRNPGCPTATEGKNFLQNVKLNLSIFNPLTQNVNSRRSSDYYKRSTSPWTLHRNENPNRYPPVIWEAECRYSGCVNAAGKEDHHVSSVPIQQEILVLQREPQNCPLSFRLEKMKVTVGCTCVTPIVRHVGHHHHHH

SEQ ID NO: 701 - protein, 139 aa, Artificial Sequence
  Description of Artificial Sequence: Synthetic polypeptide
  Rat IL-17F-6His
RRNPKVGLSALQKAGNCPPLEDNSVRVDIRIFNQNQGISVPRDFQNRSSSPWDYNITRDPDRFPSEIAEAQCRHSGCINAQGQEDGSMNSVPIQQEILVLRREPQGCSNSFRLEKMLIKVGCTCVTPIVHHAAHHHHHH

SEQ ID NO: 702 - protein, 138 aa, Artificial Sequence
  Description of Artificial Sequence: Synthetic polypeptide
  Mouse IL-17A-6His
AIIPQSSACPNTEAKDFLQNVKVNLKVFNSLGAKVSSRRPSDYLNRSTSPWTLHRNEDPDRYPSVIWEAQCRHQRCVNAEGKLDHHMNSVLIQQEILVLKREPESCPFTFRVEKMLVGVGCTCVASIVRQAAHHHHHH

SEQ ID NO: 703 - protein, 139 aa, Artificial Sequence
  Description of Artificial Sequence: Synthetic polypeptide
  Mouse IL-17F-6His
RKNPKAGVPALQKAGNCPPLEDNTVRVDIRIFNQNQGISVPREFQNRSSSPWDYNITRDPHRFPSEIAEAQCRHSGCINAQGQEDSTMNSVAIQQEILVLRREPQGCSNSFRLEKMLLKVGCTCVKPIVHQAAHHHHHH

SEQ ID NO: 704 - protein, 215 aa, Artificial Sequence
  Description of Artificial Sequence: Synthetic polypeptide
  Fab01-6His, light chain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPCTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 705 - protein, 239 aa, Artificial Sequence
  Description of Artificial Sequence: Synthetic polypeptide
  Fab01-6His, heavy chain
EVQLVESGGGLVQPGGSLRLSCAASGFTFSNYWMNWVRQAPGKGLEWVAAINQDGSEKYYVGSVKGRFTISRDNAKNSLYLQMNSLRVEDTAVYYCVRDYYDILTDYYIHYWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHHHHHH

SEQ ID NO: 706 - protein, 215 aa, Artificial Sequence; identical to SEQ ID NO: 704
  Description of Artificial Sequence: Synthetic polypeptide
  mAb02, light chain

SEQ ID NO: 707 - protein, 457 aa, Artificial Sequence
  Description of Artificial Sequence: Synthetic polypeptide
  mAb02, heavy chain
EVQLVESGGGLVQPGGSLRLSCAASGFTFSNYWMNWVRQAPGKGLEWVAAINQDGSEKYYVGSVKGRFTISRDNAKNSLYLQMNSLRVEDTAVYYCVRDYYDILTDYYIHYWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 708 - protein, 524 aa, Artificial Sequence
  Description of Artificial Sequence: Synthetic polypeptide
  Human IL-17RA-Fc
LRLLDHRALVCSQPGLNCTVKNSTCLDDSWIHPRNLTPSSPKDLQIQLHFAHTQQGDLFPVAHIEWTLQTDASILYLEGAELSVLQLNTNERLCVRFEFLSKLRHHHRRWRFTFSHFVVDPDQEYEVTVHHLPKPIPDGDPNHQSKNFLVPDCEHARMKVTTPCMSSGSLWDPNITVETLEAHQLRVSFTLWNESTHYQILLTSFPHMENHSCFEHMHHIPAPRPEEFHQRSNVTLTLRNLKGCCRHQVQIQPFFSSCLNDCLRHSATVSCPEMPDTPEPIPDYMPLWGSSGEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 709 - protein, 683 aa, Artificial Sequence
  Description of Artificial Sequence: Synthetic polypeptide
  Human IL-17RC-Fc
LERLVGPQDATHCSPGLSCRLWDSDILCLPGDIVPAPGPVLAPTHLQTELVLRCQKETDCDLCLRVAVHLAVHGHWEEPEDEEKFGGAADLGVEEPRNASLQAQVVLSFQAYPTARCVLLEVQVPAALVQFGQSVGSVVYDCFEAALGSEVRIWSYTQPRYEKELNHTQQLPDCRGLEVWNSIPSCWALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLRLLTLQSWLLDAPCSLPAEAALCWRAPGGDPCQPLVPPLSWENVTVDKVLEFPLLKGHPNLCVQVNSSEKLQLQECLWADSLGPLKDDVLLLETRGPQDNRSLCALEPSGCTSLPSKASTRAARLGEYLLQDLQSGQCLQLWDDDLGALWACPMDKYIHKRGSSGEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 710 - protein, 380 aa, Artificial Sequence
  Description of Artificial Sequence: Synthetic polypeptide
  Nanobody sequence
EVQLVESGGGLVQAGGSQRLSCTASGTIVNIHVMGWYRQAPGKQRELVALIFSGGSTDYADSVKGRFTISRDNAKNTVYLEMNSLKAEDTAVYYCAAEIGYYSGGTYYSSEAHWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQAGGSLRLSCAASGRTFSSYVVGWFRQAPGKEREFIGAISGSGDSIYYAVSEKDRFTISRDNGKNTLYLQMSSLKAEDTAVYYCTADQEFGYLRFGRSEYWGQGTQVTVSS

SEQ ID NO: 711 - protein, 380 aa, Artificial Sequence
  Description of Artificial Sequence: Synthetic polypeptide
  Nanobody sequence
EVQLVESGGGLVQAGGSLRLSCAASGRTFSSYVVGWFRQAPGKEREFIGAISGSGDSIYYAVSEKDRFTISRDNGKNTLYLQMSSLKAEDTAVYYCTADQEFGYLRFGRSEYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQAGGSQRLSCTASGTIVNIHVMGWYRQAPGKQRELVALIFSGGSTDYADSVKGRFTISRDNAKNTVYLEMNSLKAEDTAVYYCAAEIGYYSGGTYYSSEAHWGQGTQVTVSS

SEQ ID NO: 712 - protein, 407 aa, Artificial Sequence
  Description of Artificial Sequence: Synthetic polypeptide
  Nanobody sequence
EVQLVESGGGVVQPGGSLRLSCADSERSFSFNAMGWFRQAPGKEREFVAAISATGDDTYYADSVKGRFAISRDTARNTVYLQMNSLKPEDTAVYYCGARVNFDGTVSYTNDYAYWGQGTQVTVSSGGGGSGGGGSGGGGSGGGGSGGGGSGGGGSGGGGSEVQLVESGGGLVQAGGSLRLSCAASGRTFSSYVVGWFRQAPGKEREFIGAISGSGDSIYYAVSEKDRFTISRDNGKNTLYLQMSSLKAEDTAVYYCTADQEFGYLRFGRSEYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 713 - protein, 409 aa, Artificial Sequence
  Description of Artificial Sequence: Synthetic polypeptide
  Nanobody sequence
EVQLVESGGGLVQAGGSLRLSCAASGFTFDDYAIGWFRQAPGKEREAVSCFSSSDGSIYYADSVKGRFTISSDNAKNTVYLQMNSLKPEDTAVYYCAGGGGSYYYTQLNYCYDMDYWGKGTQVTVSSGGGGSGGGGSGGGGSGGGGSGGGGSGGGGSGGGGSEVQLVESGGGLVQAGGSLRLSCAASGRTFSSYVVGWFRQAPGKEREFIGAISGSGDSIYYAVSEKDRFTISRDNGKNTLYLQMSSLKAEDTAVYYCTADQEFGYLRFGRSEYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 714 - protein, 394 aa, Artificial Sequence
  Description of Artificial Sequence: Synthetic polypeptide
  Nanobody sequence
EVQLVESGGGLVQPGGSLRLSCAASGFTLGYYAIGWFRQAPGKEREGVSCDSSSDGDTYYANSVKGRFTISTDNGKNTVYLQMNSLKPEDTAVYYCATCTDWNYDYWGQGTQVTVSSGGGGSGGGGSGGGGSGGGGSGGGGSGGGGSGGGGSEVQLVESGGGLVQAGGSLRLSCVASGRAFSSYVMGWFRQAPGMEREFVALIRWSDGITGYVDSVKGRFTISRDNAKNTVYLQMNSLKPEDTAVYYCAAAVRPGDYDYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 715 - protein, 406 aa, Artificial Sequence
  Description of Artificial Sequence: Synthetic polypeptide
  Nanobody sequence
EVQLVESGGGLVQAGGSQRLSCTASGTIVNIHVMGWYRQAPGKQRELVALIFSGGSTDYADSVKGRFTISRDNAKNTVYLEMNSLKAEDTAVYYCAAEIGYYSGGTYYSSEAHWGQGTQVTVSSGGGGSGGGGSGGGGSGGGGSGGGGSGGGGSGGGGSEVQLVESGGGLVQAGGSLRLSCAASGRTFSSYVVGWFRQAPGKEREFIGAISGSGDSIYYAVSEKDRFTISRDNGKNTLYLQMSSLKAEDTAVYYCTADQEFGYLRFGRSEYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 716 - protein, 394 aa, Artificial Sequence
  Description of Artificial Sequence: Synthetic polypeptide
  Nanobody sequence
EVQLVESGGGLVQAGGSLRLSCAASDSVFTAKAVGWYRQPPGLQREWVAIITSGGKTNYADSSVKGRFTVSVDKVKNTVTLQMNSLKPEDTAVYYCYAQWMGRDYWGQGTQVTVSSGGGGSGGGGSGGGGSGGGGSGGGGSGGGGSGGGGSEVQLVESGGGLVQAGGSLRLSCPVSGRAFSRGRLGWFRQAPGKEREFVAVAHWSGAITSYADSVKGRFTFSRDNAKNTMNLQMNSLKPEDTAVYYCAADSETSGNWVYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 717 - protein, 393 aa, Artificial Sequence
  Description of Artificial Sequence: Synthetic polypeptide
  Nanobody sequence
EVQLVESGGGLVQAGGSLRLSCAASDSVFTAKAVGWYRQPPGLQREWVAIITSGGKTNYADSSVKGRFTVSVDKVKNTVTLQMNSLKPEDTAVYYCYAQWMGRDYWGQGTQVTVSSGGGGSGGGGSGGGGSGGGGSGGGGSGGGGSGGGGSEVQLVESGGGLVQAGGSLRLSCGAAGGTFSSYATGWFRQAPGKEREFVAVFRWSDSHTAYADSVKGRFTISRDGAKNTLYLQMSSLKPEDTAIYYCTTATRPGEWDYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 718 - protein, 400 aa, Artificial Sequence
  Description of Artificial Sequence: Synthetic polypeptide
  Nanobody sequence
EVQLVESGGGLVQPGESLRLSCKASGFSLDYYALGWFRQAPGKEREGISCITSSDASAYYTDSVKGRFTISRDNSKNTVYLQMNSLKTEDTAIYYCAAALLTCSSYYDAYTYWGQGTQVTVSSGGGGSGGGGSGGGGSGGGGSGGGGSGGGGSGGGGSEVQLVESGGGLVQAGGSLRLSCGASGGTFSSYATGWFRQAPGKEREFVAVLRWSDSHTAYADSVEGRFTISRDGAKNTVYLQMSSLKPEDTAIYYCTTGTRPGEWHYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 719 - protein, 394 aa, Artificial Sequence
  Description of Artificial Sequence: Synthetic polypeptide
  Nanobody sequence
EVQLVESGGGLVQAGGSLRLSCPVSGRAFSRGRLGWFRQAPGKEREFVAVAHWSGAITSYADSVKGRFTFSRDNAKNTMNLQMNSLKPEDTAVYYCAADSETSGNWVYWGQGTQVTVSSGGGGSGGGGSGGGGSGGGGSGGGGSGGGGSGGGGSEVQLVESGGGLVQAGGSLRLSCAASDSVFTAKAVGWYRQPPGLQREWVAIITSGGKTNYADSSVKGRFTVSVDKVKNTVTLQMNSLKPEDTAVYYCYAQWMGRDYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 720 - protein, 394 aa, Artificial Sequence
  Description of Artificial Sequence: Synthetic polypeptide
  Nanobody sequence
EVQLVESGGGLVQAGGSLRLSCVASGRAFSSYVMGWFRQAPGMEREFVALIRWSDGITGYVDSVKGRFTISRDNAKNTVYLQMNSLKPEDTAVYYCAAAVRPGDYDYWGQGTQVTVSSGGGGSGGGGSGGGGSGGGGSGGGGSGGGGSGGGGSEVQLVESGGGLVQPGGSLRLSCAASGFTLGYYAIGWFRQAPGKEREGVSCDSSSDGDTYYANSVKGRFTISTDNGKNTVYLQMNSLKPEDTAVYYCATCTDWNYDYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 721 - protein, 400 aa, Artificial Sequence
  Description of Artificial Sequence: Synthetic polypeptide
  Nanobody sequence
EVQLVESGGGLVQAGGSLRLSCGASGGTFSSYATGWFRQAPGKEREFVAVLRWSDSHTAYADSVEGRFTISRDGAKNTVYLQMSSLKPEDTAIYYCTTGTRPGEWHYWGQGTQVTVSSGGGGSGGGGSGGGGSGGGGSGGGGSGGGGSGGGGSEVQLVESGGGLVQPGESLRLSCKASGFSLDYYALGWFRQAPGKEREGISCITSSDASAYYTDSVKGRFTISRDNSKNTVYLQMNSLKTEDTAIYYCAAALLTCSSYYDAYTYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 722 - protein, 407 aa, Artificial Sequence
  Description of Artificial Sequence: Synthetic polypeptide
  Nanobody sequence
EVQLVESGGGLVQAGGSLRLSCAASGRTFSSYVVGWFRQAPGKEREFIGAISGSGDSIYYAVSEKDRFTISRDNGKNTLYLQMSSLKAEDTAVYYCTADQEFGYLRFGRSEYWGQGTQVTVSSGGGGSGGGGSGGGGSGGGGSGGGGSGGGGSGGGGSEVQLVESGGGVVQPGGSLRLSCADSERSFSFNAMGWFRQAPGKEREFVAAISATGDDTYYADSVKGRFAISRDTARNTVYLQMNSLKPEDTAVYYCGARVNFDGTVSYTNDYAYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 723 - protein, 409 aa, Artificial Sequence
  Description of Artificial Sequence: Synthetic polypeptide
  Nanobody sequence
EVQLVESGGGLVQAGGSLRLSCAASGRTFSSYVVGWFRQAPGKEREFIGAISGSGDSIYYAVSEKDRFTISRDNGKNTLYLQMSSLKAEDTAVYYCTADQEFGYLRFGRSEYWGQGTQVTVSSGGGGSGGGGSGGGGSGGGGSGGGGSGGGGSGGGGSEVQLVESGGGLVQAGGSLRLSCAASGFTFDDYAIGWFRQAPGKEREAVSCFSSSDGSIYYADSVKGRFTISSDNAKNTVYLQMNSLKPEDTAVYYCAGGGGSYYYTQLNYCYDMDYWGKGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 724 - protein, 406 aa, Artificial Sequence
  Description of Artificial Sequence: Synthetic polypeptide
  Nanobody sequence
EVQLVESGGGLVQAGGSLRLSCAASGRTFSSYVVGWFRQAPGKEREFIGAISGSGDSIYYAVSEKDRFTISRDNGKNTLYLQMSSLKAEDTAVYYCTADQEFGYLRFGRSEYWGQGTQVTVSSGGGGSGGGGSGGGGSGGGGSGGGGSGGGGSGGGGSEVQLVESGGGLVQAGGSQRLSCTASGTIVNIHVMGWYRQAPGKQRELVALIFSGGSTDYADSVKGRFTISRDNAKNTVYLEMNSLKAEDTAVYYCAAEIGYYSGGTYYSSEAHWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 725 - protein, 401 aa, Artificial Sequence
  Description of Artificial Sequence: Synthetic polypeptide
  Nanobody sequence
EVQLVESGGGLVQAGGSLRLSCGAAGGTFSSYATGWFRQAPGKEREFVAVFRWSDSHTAYADSVKGRFTISRDGAKNTLYLQMSSLKPEDTAIYYCTTATRPGEWDYWGQGTQVTVSSGGGGSGGGGSGGGGSGGGGSGGGGSGGGGSGGGGSEVQLVESGGGLVQAGGSQRLSCTASGTIVNIHVMGWYRQAPGKQRELVALIFSGGSTDYADSVKGRFTISRDNAKNTVYLEMNSLKAEDTAVYYCAAEIGYYSGGTYYSSEAHWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 726 - protein, 389 aa, Artificial Sequence
  Description of Artificial Sequence: Synthetic polypeptide
  Nanobody sequence
EVQLVESGGGLVQAGGSLRLSCAASGFTFDDYDIGWFRQAPGKEREGVSCFTSSDGRTFYADSVKGRFTVSADNAKNTVYLQMNSLEPEDTAVYFCAAVNTFDESAYAAFACYDVVRWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQAGGSLRLSCAASGFTFDDYDIGWFRQAPGKEREGVSCFTSSDGRTFYADSVKGRFTVSADNAKNTVYLQMNSLEPEDTAVYFCAAVNTFDESAYAAFACYDVVRWGQGTQVTVSS

SEQ ID NO: 727 - protein, 365 aa, Artificial Sequence
  Description of Artificial Sequence: Synthetic polypeptide
  Nanobody sequence
EVQLVESGGGSVQAGDSLRLSCAASGRANSINWFGWFRQTPGKEREFVAGIRWSDAYTEYANSVKGRFTISRDNAKNTVDLQMDSLKPEDTAVYYCVLDLSTVRYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGSVQAGDSLRLSCAASGRANSINWFGWFRQTPGKEREFVAGIRWSDAYTEYANSVKGRFTISRDNAKNTVDLQMDSLKPEDTAVYYCVLDLSTVRYWGQGTQVTVSS

SEQ ID NO: 728 - protein, 383 aa, Artificial Sequence
  Description of Artificial Sequence: Synthetic polypeptide
  Nanobody sequence
EVQLVESGGRLVQAGGSLRLSCAASGRTFTSYPMGWFRQAPGKEREFVAAISMSGDDTAYTDFVRGRFTISRDDARNTVYLHMTSLKPEDTAVYYCAARTSYDGTYDYIDDYSYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGRLVQAGGSLRLSCAASGRTFTSYPMGWFRQAPGKEREFVAAISMSGDDTAYTDFVRGRFTISRDDARNTVYLHMTSLKPEDTAVYYCAARTSYDGTYDYIDDYSYWGQGTQVTVSS

SEQ ID NO: 729 - protein, 377 aa, Artificial Sequence
  Description of Artificial Sequence: Synthetic polypeptide
  Nanobody sequence
EVQLVESGGGLVQAGGSLRLSCAASGRTYDAMGWLRQAPGKEREFVAAISGSGDDTYYADSVKGRFTISKDNAGITMYLQMNSLKPEDTAVYYCATRRGLYYVWDSNDYENWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQAGGSLRLSCAASGRTYDAMGWLRQAPGKEREFVAAISGSGDDTYYADSVKGRFTISKDNAGITMYLQMNSLKPEDTAVYYCATRRGLYYVWDSNDYENWGQGTQVTVSS

SEQ ID NO: 730 - protein, 371 aa, Artificial Sequence
  Description of Artificial Sequence: Synthetic polypeptide
  Nanobody sequence
EVQLVESGGGKVQAGDSLTLSCVASGGTFSNYAAWFRQAPGKDRRELVVSIFRTGSITYTADSVKGRFTASRVNTKNTVYLQMNSLKPEDTAVYYCASAYNPGVGYDYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGKVQAGDSLTLSCVASGGTFSNYAAWFRQAPGKDRRELVVSIFRTGSITYTADSVKGRFTASRVNTKNTVYLQMNSLKPEDTAVYYCASAYNPGVGYDYWGQGTQVTVSS

SEQ ID NO: 731 - protein, 415 aa, Artificial Sequence
  Description of Artificial Sequence: Synthetic polypeptide
  Nanobody sequence
EVQLVESGGGLVQAGGSLRLSCAASGFTFDDYDIGWFRQAPGKEREGVSCFTSSDGRTFYADSVKGRFTVSADNAKNTVYLQMNSLEPEDTAVYFCAAVNTFDESAYAAFACYDVVRWGQGTQVTVSSGGGGSGGGGSGGGGSGGGGSGGGGSGGGGSGGGGSEVQLVESGGGLVQAGGSLRLSCAASGFTFDDYDIGWFRQAPGKEREGVSCFTSSDGRTFYADSVKGRFTVSADNAKNTVYLQMNSLEPEDTAVYFCAAVNTFDESAYAAFACYDVVRWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 732 - protein, 389 aa, Artificial Sequence
  Description of Artificial Sequence: Synthetic polypeptide
  Nanobody sequence
EVQLVESGGGLVQAGGSLRLSCAASGVIFRLNAMGWYRAAPGKQRELVAIIVNGGSTNYADSVKGRFTISRDSAKNAVYLQMNSLKPEDTAVYYCYYNIPGDVYWGQGTQVTVSSGGGGSGGGGSGGGGSGGGGSGGGGSGGGGSGGGGSEVQLVESGGGLVQAGGSLRLSCAASGVIFRLNAMGWYRAAPGKQRELVAIIVNGGSTNYADSVKGRFTISRDSAKNAVYLQMNSLKPEDTAVYYCYYNIPGDVYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 733 - protein, 391 aa, Artificial Sequence
  Description of Artificial Sequence: Synthetic polypeptide
  Nanobody sequence
EVQLVESGGGSVQAGDSLRLSCAASGRANSINWFGWFRQTPGKEREFVAGIRWSDAYTEYANSVKGRFTISRDNAKNTVDLQMDSLKPEDTAVYYCVLDLSTVRYWGQGTQVTVSSGGGGSGGGGSGGGGSGGGGSGGGGSGGGGSGGGGSEVQLVESGGGSVQAGDSLRLSCAASGRANSINWFGWFRQTPGKEREFVAGIRWSDAYTEYANSVKGRFTISRDNAKNTVDLQMDSLKPEDTAVYYCVLDLSTVRYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 734 - protein, 409 aa, Artificial Sequence
  Description of Artificial Sequence: Synthetic polypeptide
  Nanobody sequence
EVQLVESGGRLVQAGGSLRLSCAASGRTFTSYPMGWFRQAPGKEREFVAAISMSGDDTAYTDFVRGRFTISRDDARNTVYLHMTSLKPEDTAVYYCAARTSYDGTYDYIDDYSYWGQGTQVTVSSGGGGSGGGGSGGGGSGGGGSGGGGSGGGGSGGGGSEVQLVESGGRLVQAGGSLRLSCAASGRTFTSYPMGWFRQAPGKEREFVAAISMSGDDTAYTDFVRGRFTISRDDARNTVYLHMTSLKPEDTAVYYCAARTSYDGTYDYIDDYSYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 735 - protein, 403 aa, Artificial Sequence
  Description of Artificial Sequence: Synthetic polypeptide
  Nanobody sequence
EVQLVESGGGLVQAGGSLRLSCAASGRTYDAMGWLRQAPGKEREFVAAISGSGDDTYYADSVKGRFTISKDNAGITMYLQMNSLKPEDTAVYYCATRRGLYYVWDSNDYENWGQGTQVTVSSGGGGSGGGGSGGGGSGGGGSGGGGSGGGGSGGGGSEVQLVESGGGLVQAGGSLRLSCAASGRTYDAMGWLRQAPGKEREFVAAISGSGDDTYYADSVKGRFTISKDNAGITMYLQMNSLKPEDTAVYYCATRRGLYYVWDSNDYENWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 736 - protein, 397 aa, Artificial Sequence
  Description of Artificial Sequence: Synthetic polypeptide
  Nanobody sequence
EVQLVESGGGKVQAGDSLTLSCVASGGTFSNYAAWFRQAPGKDRRELVVSIFRTGSITYTADSVKGRFTASRVNTKNTVYLQMNSLKPEDTAVYYCASAYNPGVGYDYWGQGTQVTVSSGGGGSGGGGSGGGGSGGGGSGGGGSGGGGSGGGGSEVQLVESGGGKVQAGDSLTLSCVASGGTFSNYAAWFRQAPGKDRRELVVSIFRTGSITYTADSVKGRFTASRVNTKNTVYLQMNSLKPEDTAVYYCASAYNPGVGYDYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 737 - protein, 409 aa, Artificial Sequence
  Description of Artificial Sequence: Synthetic polypeptide
  Nanobody sequence
EVQLVESGGRLVQAGGSLRLPCAASGRTFTSYPMGWFRQAPGKEREFVAAISMSGDDAAYADFVRGRFTISRDDARNTVYLHMTSLKPEDTAVYYCAARTSYDGTYDYIDDYSYWGQGTQVTVSSGGGGSGGGGSGGGGSGGGGSGGGGSGGGGSGGGGSEVQLVESGGRLVQAGGSLRLPCAASGRTFTSYPMGWFRQAPGKEREFVAAISMSGDDAAYADFVRGRFTISRDDARNTVYLHMTSLKPEDTAVYYCAARTSYDGTYDYIDDYSYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 738 - protein, 368 aa, Artificial Sequence
  Description of Artificial Sequence: Synthetic polypeptide
  Nanobody sequence
EVQLVESGGGLVQAGGSLRLSCPVSGRAFSRGRLGWFRQAPGKEREFVAVAHWSGAITSYADSVKGRFTFSRDNAKNTMNLQMNSLKPEDTAVYYCAADSETSGNWVYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGSVQAGDSLRLSCAASGRANSINWFGWFRQTPGKEREFVAGIRWSDAYTEYANSVKGRFTISRDNAKNTVDLQMDSLKPEDTAVYYCVLDLSTVRYWGQGTQVTVSS

SEQ ID NO: 739 - protein, 374 aa, Artificial Sequence
  Description of Artificial Sequence: Synthetic polypeptide
  Nanobody sequence
EVQLVESGGGLVQAGGSLRLSCPVSGRAFSRGRLGWFRQAPGKEREFVAVAHWSGAITSYADSVKGRFTFSRDNAKNTMNLQMNSLKPEDTAVYYCAADSETSGNWVYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQAGGSLRLSCAASGRTYDAMGWLRQAPGKEREFVAAISGSGDDTYYADSVKGRFTISKDNAGITMYLQMNSLKPEDTAVYYCATRRGLYYVWDSNDYENWGQGTQVTVSS

SEQ ID NO: 740 - protein, 367 aa, Artificial Sequence
  Description of Artificial Sequence: Synthetic polypeptide
  Nanobody sequence
EVQLVESGGGLVQAGGSLRLSCGASGGTFSSYATGWFRQAPGKEREFVAVLRWSDSHTAYADSVEGRFTISRDGAKNTVYLQMSSLKPEDTAIYYCTTGTRPGEWHYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGSVQAGDSLRLSCAASGRANSINWFGWFRQTPGKEREFVAGIRWSDAYTEYANSVKGRFTISRDNAKNTVDLQMDSLKPEDTAVYYCVLDLSTVRYWGQGTQVTVSS

SEQ ID NO: 741 - protein, 373 aa, Artificial Sequence
  Description of Artificial Sequence: Synthetic polypeptide
  Nanobody sequence
EVQLVESGGGLVQAGGSLRLSCGASGGTFSSYATGWFRQAPGKEREFVAVLRWSDSHTAYADSVEGRFTISRDGAKNTVYLQMSSLKPEDTAIYYCTTGTRPGEWHYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQAGGSLRLSCAASGRTYDAMGWLRQAPGKEREFVAAISGSGDDTYYADSVKGRFTISKDNAGITMYLQMNSLKPEDTAVYYCATRRGLYYVWDSNDYENWGQGTQVTVSS

SEQ ID NO: 742 - protein, 372 aa, Artificial Sequence
  Description of Artificial Sequence: Synthetic polypeptide
  Nanobody sequence
EVQLVESGGGLVQAGGSLRLSCAASGRTFSSYVVGWFRQAPGKEREFIGAISGSGDSIYYAVSEKDRFTISRDNGKNTLYLQMSSLKAEDTAVYYCTADQEFGYLRFGRSEYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGSVQAGDSLRLSCAASGRANSINWFGWFRQTPGKEREFVAGIRWSDAYTEYANSVKGRFTISRDNAKNTVDLQMDSLKPEDTAVYYCVLDLSTVRYWGQGTQVTVSS

SEQ ID NO: 743 - protein, 378 aa, Artificial Sequence
  Description of Artificial Sequence: Synthetic polypeptide
  Nanobody sequence
EVQLVESGGGLVQAGGSLRLSCAASGRTFSSYVVGWFRQAPGKEREFIGAISGSGDSIYYAVSEKDRFTISRDNGKNTLYLQMSSLKAEDTAVYYCTADQEFGYLRFGRSEYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQAGGSLRLSCAASGRTYDAMGWLRQAPGKEREFVAAISGSGDDTYYADSVKGRFTISKDNAGITMYLQMNSLKPEDTAVYYCATRRGLYYVWDSNDYENWGQGTQVTVSS

SEQ ID NO: 744 - protein, 379 aa, Artificial Sequence
  Description of Artificial Sequence: Synthetic polypeptide
  Nanobody sequence
EVQLVESGGGLVQAGGSLRLSCGAAGGTFSSYATGWFRQAPGKEREFVAVFRWSDSHTAYADSVKGRFTISRDGAKNTLYLQMSSLKPEDTAIYYCTTATRPGEWDYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQAGGSLRLSCAASGFTFDDYDIGWFRQAPGKEREGVSCFTSSDGRTFYADSVKGRFTVSADNAKNTVYLQMNSLEPEDTAVYFCAAVNTFDESAYAAFACYDVVRWGQGTQVTVSS

SEQ ID NO: 745 - protein, 379 aa, Artificial Sequence
  Description of Artificial Sequence: Synthetic polypeptide
  Nanobody sequence
EVQLVESGGGLVQAGGSLRLSCAASGFTFDDYDIGWFRQAPGKEREGVSCFTSSDGRTFYADSVKGRFTVSADNAKNTVYLQMNSLEPEDTAVYFCAAVNTFDESAYAAFACYDVVRWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQAGGSLRLSCGAAGGTFSSYATGWFRQAPGKEREFVAVFRWSDSHTAYADSVKGRFTISRDGAKNTLYLQMSSLKPEDTAIYYCTTATRPGEWDYWGQGTQVTVSS

SEQ ID NO: 746 - protein, 368 aa, Artificial Sequence
  Description of Artificial Sequence: Synthetic polypeptide
  Nanobody sequence
EVQLVESGGGSVQAGDSLRLSCAASGRANSINWFGWFRQTPGKEREFVAGIRWSDAYTEYANSVKGRFTISRDNAKNTVDLQMDSLKPEDTAVYYCVLDLSTVRYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQAGGSLRLSCPVSGRAFSRGRLGWFRQAPGKEREFVAVAHWSGAITSYADSVKGRFTFSRDNAKNTMNLQMNSLKPEDTAVYYCAADSETSGNWVYWGQGTQVTVSS

SEQ ID NO: 747 - protein, 367 aa, Artificial Sequence
  Description of Artificial Sequence: Synthetic polypeptide
  Nanobody sequence
EVQLVESGGGSVQAGDSLRLSCAASGRANSINWFGWFRQTPGKEREFVAGIRWSDAYTEYANSVKGRFTISRDNAKNTVDLQMDSLKPEDTAVYYCVLDLSTVRYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQAGGSLRLSCGASGGTFSSYATGWFRQAPGKEREFVAVLRWSDSHTAYADSVEGRFTISRDGAKNTVYLQMSSLKPEDTAIYYCTTGTRPGEWHYWGQGTQVTVSS

SEQ ID NO: 748 - protein, 372 aa, Artificial Sequence
  Description of Artificial Sequence: Synthetic polypeptide
  Nanobody sequence
EVQLVESGGGSVQAGDSLRLSCAASGRANSINWFGWFRQTPGKEREFVAGIRWSDAYTEYANSVKGRFTISRDNAKNTVDLQMDSLKPEDTAVYYCVLDLSTVRYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQAGGSLRLSCAASGRTFSSYVVGWFRQAPGKEREFIGAISGSGDSIYYAVSEKDRFTISRDNGKNTLYLQMSSLKAEDTAVYYCTADQEFGYLRFGRSEYWGQGTQVTVSS

SEQ ID NO: 749 - protein, 374 aa, Artificial Sequence
  Description of Artificial Sequence: Synthetic polypeptide
  Nanobody sequence
EVQLVESGGGLVQAGGSLRLSCAASGRTYDAMGWLRQAPGKEREFVAAISGSGDDTYYADSVKGRFTISKDNAGITMYLQMNSLKPEDTAVYYCATRRGLYYVWDSNDYENWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQAGGSLRLSCPVSGRAFSRGRLGWFRQAPGKEREFVAVAHWSGAITSYADSVKGRFTFSRDNAKNTMNLQMNSLKPEDTAVYYCAADSETSGNWVYWGQGTQVTVSS

SEQ ID NO: 750 - protein, 373 aa, Artificial Sequence
  Description of Artificial Sequence: Synthetic polypeptide
  Nanobody sequence
EVQLVESGGGLVQAGGSLRLSCAASGRTYDAMGWLRQAPGKEREFVAAISGSGDDTYYADSVKGRFTISKDNAGITMYLQMNSLKPEDTAVYYCATRRGLYYVWDSNDYENWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQAGGSLRLSCGASGGTFSSYATGWFRQAPGKEREFVAVLRWSDSHTAYADSVEGRFTISRDGAKNTVYLQMSSLKPEDTAIYYCTTGTRPGEWHYWGQGTQVTVSS

SEQ ID NO: 751 - protein, 378 aa, Artificial Sequence
  Description of Artificial Sequence: Synthetic polypeptide
  Nanobody sequence
EVQLVESGGGLVQAGGSLRLSCAASGRTYDAMGWLRQAPGKEREFVAAISGSGDDTYYADSVKGRFTISKDNAGITMYLQMNSLKPEDTAVYYCATRRGLYYVWDSNDYENWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQAGGSLRLSCAASGRTFSSYVVGWFRQAPGKEREFIGAISGSGDSIYYAVSEKDRFTISRDNGKNTLYLQMSSLKAEDTAVYYCTADQEFGYLRFGRSEYWGQGTQVTVSS

SEQ ID NO: 752 - protein, 405 aa, Artificial Sequence
  Description of Artificial Sequence: Synthetic polypeptide
  Nanobody sequence
EVQLVESGGGLVQAGGSLRLSCVASGRAFSSYVMGWFRQAPGMEREFVALIRWSDGITGYVDSVKGRFTISRDNAKNTVYLQMNSLKPEDTAVYYCAAAVRPGDYDYWGQGTQVTVSSGGGGSGGGGSGGGGSGGGGSGGGGSGGGGSGGGGSEVQLVESGGGLVQAGGSLRLSCAASGFTFDDYDIGWFRQAPGKEREGVSCFTSSDGRTFYADSVKGRFTVSADNAKNTVYLQMNSLEPEDTAVYFCAAVNTFDESAYAAFACYDVVRWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 753 - protein, 398 aa, Artificial Sequence
  Description of Artificial Sequence: Synthetic polypeptide
  Nanobody sequence
EVQLVESGGGLVQAGGSLRLSCAASGRTFSSYVVGWFRQAPGKEREFIGAISGSGDSIYYAVSEKDRFTISRDNGKNTLYLQMSSLKAEDTAVYYCTADQEFGYLRFGRSEYWGQGTQVTVSSGGGGSGGGGSGGGGSGGGGSGGGGSGGGGSGGGGSEVQLVESGGGSVQAGDSLRLSCAASGRANSINWFGWFRQTPGKEREFVAGIRWSDAYTEYANSVKGRFTISRDNAKNTVDLQMDSLKPEDTAVYYCVLDLSTVRYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 754 - protein, 404 aa, Artificial Sequence
  Description of Artificial Sequence: Synthetic polypeptide
  Nanobody sequence
EVQLVESGGGLVQAGGSLRLSCAASGRTFSSYVVGWFRQAPGKEREFIGAISGSGDSIYYAVSEKDRFTISRDNGKNTLYLQMSSLKAEDTAVYYCTADQEFGYLRFGRSEYWGQGTQVTVSSGGGGSGGGGSGGGGSGGGGSGGGGSGGGGSGGGGSEVQLVESGGGLVQAGGSLRLSCAASGRTYDAMGWLRQAPGKEREFVAAISGSGDDTYYADSVKGRFTISKDNAGITMYLQMNSLKPEDTAVYYCATRRGLYYVWDSNDYENWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 755 - protein, 405 aa, Artificial Sequence
  Description of Artificial Sequence: Synthetic polypeptide
  Nanobody sequence
EVQLVESGGGLVQAGGSLRLSCGAAGGTFSSYATGWFRQAPGKEREFVAVFRWSDSHTAYADSVKGRFTISRDGAKNTLYLQMSSLKPEDTAIYYCTTATRPGEWDYWGQGTQVTVSSGGGGSGGGGSGGGGSGGGGSGGGGSGGGGSGGGGSEVQLVESGGGLVQAGGSLRLSCAASGFTFDDYDIGWFRQAPGKEREGVSCFTSSDGRTFYADSVKGRFTVSADNAKNTVYLQMNSLEPEDTAVYFCAAVNTFDESAYAAFACYDVVRWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 756 - protein, 405 aa, Artificial Sequence
  Description of Artificial Sequence: Synthetic polypeptide
  Nanobody sequence
EVQLVESGGGLVQAGGSLRLSCAASGFTFDDYDIGWFRQAPGKEREGVSCFTSSDGRTFYADSVKGRFTVSADNAKNTVYLQMNSLEPEDTAVYFCAAVNTFDESAYAAFACYDVVRWGQGTQVTVSSGGGGSGGGGSGGGGSGGGGSGGGGSGGGGSGGGGSEVQLVESGGGLVQAGGSLRLSCVASGRAFSSYVMGWFRQAPGMEREFVALIRWSDGITGYVDSVKGRFTISRDNAKNTVYLQMNSLKPEDTAVYYCAAAVRPGDYDYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 757 - protein, 405 aa, Artificial Sequence
  Description of Artificial Sequence: Synthetic polypeptide
  Nanobody sequence
EVQLVESGGGLVQAGGSLRLSCAASGFTFDDYDIGWFRQAPGKEREGVSCFTSSDGRTFYADSVKGRFTVSADNAKNTVYLQMNSLEPEDTAVYFCAAVNTFDESAYAAFACYDVVRWGQGTQVTVSSGGGGSGGGGSGGGGSGGGGSGGGGSGGGGSGGGGSEVQLVESGGGLVQAGGSLRLSCGAAGGTFSSYATGWFRQAPGKEREFVAVFRWSDSHTAYADSVKGRFTISRDGAKNTLYLQMSSLKPEDTAIYYCTTATRPGEWDYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 758 - protein, 398 aa, Artificial Sequence
  Description of Artificial Sequence: Synthetic polypeptide
  Nanobody sequence
EVQLVESGGGSVQAGDSLRLSCAASGRANSINWFGWFRQTPGKEREFVAGIRWSDAYTEYANSVKGRFTISRDNAKNTVDLQMDSLKPEDTAVYYCVLDLSTVRYWGQGTQVTVSSGGGGSGGGGSGGGGSGGGGSGGGGSGGGGSGGGGSEVQLVESGGGLVQAGGSLRLSCAASGRTFSSYVVGWFRQAPGKEREFIGAISGSGDSIYYAVSEKDRFTISRDNGKNTLYLQMSSLKAEDTAVYYCTADQEFGYLRFGRSEYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 759 - protein, 404 aa, Artificial Sequence
  Description of Artificial Sequence: Synthetic polypeptide
  Nanobody sequence
EVQLVESGGGLVQAGGSLRLSCAASGRTYDAMGWLRQAPGKEREFVAAISGSGDDTYYADSVKGRFTISKDNAGITMYLQMNSLKPEDTAVYYCATRRGLYYVWDSNDYENWGQGTQVTVSSGGGGSGGGGSGGGGSGGGGSGGGGSGGGGSGGGGSEVQLVESGGGLVQAGGSLRLSCAASGRTFSSYVVGWFRQAPGKEREFIGAISGSGDSIYYAVSEKDRFTISRDNGKNTLYLQMSSLKAEDTAVYYCTADQEFGYLRFGRSEYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 760 - protein, 124 aa, Artificial Sequence
  Description of Artificial Sequence: Synthetic polypeptide
  Nanobody sequence
EVQLVESGGGLVQPGGSQRLSCTASGTIVNIHVMGWYRQAPGKQRELVALIFSGGSADYADSVKGRFTISRDNSKNTVYLQMNSLRAEDTAVYYCAAEIGYYSGGTYYSSEAHWGQGTLVTVSS

SEQ ID NO: 761 - protein, 124 aa, Artificial Sequence
  Description of Artificial Sequence: Synthetic polypeptide
  Nanobody sequence
EVQLVESGGGLVQPGGSLRLSCTASGTIVNIHVMGWYRQAPGKQRELVALIFSGGSADYADSVKGRFTISRDNSKNTVYLQMNSLRAEDTAVYYCAAEIGYYSGGTYYSSEAHWGQGTLVTVSS

SEQ ID NO: 762 - protein, 124 aa, Artificial Sequence
  Description of Artificial Sequence: Synthetic polypeptide
  Nanobody sequence
EVQLVESGGGLVQPGGSQRLSCAASGTIVNIHVMGWYRQAPGKQRELVALIFSGGSADYADSVKGRFTISRDNSKNTVYLQMNSLRAEDTAVYYCAAEIGYYSGGTYYSSEAHWGQGTLVTVSS

SEQ ID NO: 763 - protein, 124 aa, Artificial Sequence
  Description of Artificial Sequence: Synthetic polypeptide
  Nanobody sequence
EVQLVESGGGLVQPGGSQRLSCTASGTIVNIHVMGWYRQAPGKQRELVALIFSGGSADYADSVKGRFTISRDNSKNTVYLQMNSLRPEDTAVYYCAAEIGYYSGGTYYSSEAHWGQGTLVTVSS

SEQ ID NO: 764 - protein, 124 aa, Artificial Sequence
  Description of Artificial Sequence: Synthetic polypeptide
  Nanobody sequence
EVQLVESGGGLVQPGGSLRLSCAASGTIVNIHVMGWYRQAPGKQRELVALIFSGGSADYADSVKGRFTISRDNSKNTVYLQMNSLRAEDTAVYYCAAEIGYYSGGTYYSSEAHWGQGTLVTVSS

SEQ ID NO: 765 - protein, 124 aa, Artificial Sequence
  Description of Artificial Sequence: Synthetic polypeptide
  Nanobody sequence
EVQLVESGGGLVQPGGSLRLSCTASGTIVNIHVMGWYRQAPGKQRELVALIFSGGSADYADSVKGRFTISRDNSKNTVYLQMNSLRPEDTAVYYCAAEIGYYSGGTYYSSEAHWGQGTLVTVSS

SEQ ID NO: 766 - protein, 124 aa, Artificial Sequence
  Description of Artificial Sequence: Synthetic polypeptide
  Nanobody sequence
EVQLVESGGGLVQPGGSQRLSCAASGTIVNIHVMGWYRQAPGKQRELVALIFSGGSADYADSVKGRFTISRDNSKNTVYLQMNSLRPEDTAVYYCAAEIGYYSGGTYYSSEAHWGQGTLVTVSS

SEQ ID NO: 767 - protein, 124 aa, Artificial Sequence
  Description of Artificial Sequence: Synthetic polypeptide
  Nanobody sequence
EVQLVESGGGLVQPGGSLRLSCAASGTIVNIHVMGWYRQAPGKQRELVALIFSGGSADYADSVKGRFTISRDNSKNTVYLQMNSLRPEDTAVYYCAAEIGYYSGGTYYSSEAHWGQGTLVTVSS

SEQ ID NO: 768 - protein, 122 aa, Artificial Sequence
  Description of Artificial Sequence: Synthetic polypeptide
  Nanobody sequence
EVQLVESGGGLVQPGGSLRLSCAASGRTYDAMGWLRQAPGKEREFVAAISGSGDDTYYADSVKGRFTISKDNSGITMYLQMNSLRPEDTAVYYCATRRGLYYVWDSNDYENWGQGTLVTVSS

SEQ ID NO: 769 - protein, 122 aa, Artificial Sequence
  Description of Artificial Sequence: Synthetic polypeptide
  Nanobody sequence
EVQLVESGGGLVQPGGSLRLSCAASGRTYDAMGWFRQAPGKEREFVAAISGSGDDTYYADSVKGRFTISKDNSGITMYLQMNSLRPEDTAVYYCATRRGLYYVWDSNDYENWGQGTLVTVSS

SEQ ID NO: 770 - protein, 122 aa, Artificial Sequence
  Description of Artificial Sequence: Synthetic polypeptide
  Nanobody sequence
EVQLVESGGGLVQPGGSLRLSCAASGRTYDAMGWLRQAPGKEREFVAAISGSGDDTYYADSVKGRFTISRDNSGITMYLQMNSLRPEDTAVYYCATRRGLYYVWDSNDYENWGQGTLVTVSS

SEQ ID NO: 771 - protein, 122 aa, Artificial Sequence
  Description of Artificial Sequence: Synthetic polypeptide
  Nanobody sequence
EVQLVESGGGLVQPGGSLRLSCAASGRTYDAMGWLRQAPGKEREFVAAISGSGDDTYYADSVKGRFTISKDNSKITMYLQMNSLRPEDTAVYYCATRRGLYYVWDSNDYENWGQGTLVTVSS

SEQ ID NO: 772 - protein, 122 aa, Artificial Sequence
  Description of Artificial Sequence: Synthetic polypeptide
  Nanobody sequence
EVQLVESGGGLVQPGGSLRLSCAASGRTYDAMGWLRQAPGKEREFVAAISGSGDDTYYADSVKGRFTISKDNSGNTMYLQMNSLRPEDTAVYYCATRRGLYYVWDSNDYENWGQGTLVTVSS

SEQ ID NO: 773 - protein, 122 aa, Artificial Sequence
  Description of Artificial Sequence: Synthetic polypeptide
  Nanobody sequence
EVQLVESGGGLVQPGGSLRLSCAASGRTYDAMGWFRQAPGKEREFVAAISGSGDDTYYADSVKGRFTISRDNSGITMYLQMNSLRPEDTAVYYCATRRGLYYVWDSNDYENWGQGTLVTVSS

SEQ ID NO: 774 - protein, 122 aa, Artificial Sequence
  Description of Artificial Sequence: Synthetic polypeptide
  Nanobody sequence
EVQLVESGGGLVQPGGSLRLSCAASGRTYDAMGWFRQAPGKEREFVAAISGSGDDTYYADSVKGRFTISKDNSKITMYLQMNSLRPEDTAVYYCATRRGLYYVWDSNDYENWGQGTLVTVSS

SEQ ID NO: 775 - protein, 122 aa, Artificial Sequence
  Description of Artificial Sequence: Synthetic polypeptide
  Nanobody sequence
EVQLVESGGGLVQPGGSLRLSCAASGRTYDAMGWFRQAPGKEREFVAAISGSGDDTYYADSVKGRFTISKDNSGNTMYLQMNSLRPEDTAVYYCATRRGLYYVWDSNDYENWGQGTLVTVSS

SEQ ID NO: 776 - protein, 122 aa, Artificial Sequence
  Description of Artificial Sequence: Synthetic polypeptide
  Nanobody sequence
EVQLVESGGGLVQPGGSLRLSCAASGRTYDAMGWLRQAPGKEREFVAAISGSGDDTYYADSVKGRFTISRDNSKITMYLQMNSLRPEDTAVYYCATRRGLYYVWDSNDYENWGQGTLVTVSS

SEQ ID NO: 777 - protein, 122 aa, Artificial Sequence
  Description of Artificial Sequence: Synthetic polypeptide
  Nanobody sequence
EVQLVESGGGLVQPGGSLRLSCAASGRTYDAMGWLRQAPGKEREFVAAISGSGDDTYYADSVKGRFTISRDNSGNTMYLQMNSLRPEDTAVYYCATRRGLYYVWDSNDYENWGQGTLVTVSS

SEQ ID NO: 778 - protein, 122 aa, Artificial Sequence
  Description of Artificial Sequence: Synthetic polypeptide
  Nanobody sequence
EVQLVESGGGLVQPGGSLRLSCAASGRTYDAMGWLRQAPGKEREFVAAISGSGDDTYYADSVKGRFTISKDNSKNTMYLQMNSLRPEDTAVYYCATRRGLYYVWDSNDYENWGQGTLVTVSS

SEQ ID NO: 779 - protein, 122 aa, Artificial Sequence
  Description of Artificial Sequence: Synthetic polypeptide
  Nanobody sequence
EVQLVESGGGLVQPGGSLRLSCAASGRTYDAMGWFRQAPGKEREFVAAISGSGDDTYYADSVKGRFTISRDNSKITMYLQMNSLRPEDTAVYYCATRRGLYYVWDSNDYENWGQGTLVTVSS

SEQ ID NO: 780 - protein, 122 aa, Artificial Sequence
  Description of Artificial Sequence: Synthetic polypeptide
  Nanobody sequence
EVQLVESGGGLVQPGGSLRLSCAASGRTYDAMGWFRQAPGKEREFVAAISGSGDDTYYADSVKGRFTISKDNSKNTMYLQMNSLRPEDTAVYYCATRRGLYYVWDSNDYENWGQGTLVTVSS

SEQ ID NO: 781 - protein, 122 aa, Artificial Sequence
  Description of Artificial Sequence: Synthetic polypeptide
  Nanobody sequence
EVQLVESGGGLVQPGGSLRLSCAASGRTYDAMGWFRQAPGKEREFVAAISGSGDDTYYADSVKGRFTISRDNSGNTMYLQMNSLRPEDTAVYYCATRRGLYYVWDSNDYENWGQGTLVTVSS

SEQ ID NO: 782 - protein, 122 aa, Artificial Sequence
  Description of Artificial Sequence: Synthetic polypeptide
  Nanobody sequence
EVQLVESGGGLVQPGGSLRLSCAASGRTYDAMGWLRQAPGKEREFVAAISGSGDDTYYADSVKGRFTISRDNSKNTMYLQMNSLRPEDTAVYYCATRRGLYYVWDSNDYENWGQGTLVTVSS

SEQ ID NO: 783 - protein, 122 aa, Artificial Sequence
  Description of Artificial Sequence: Synthetic polypeptide
  Nanobody sequence
EVQLVESGGGLVQPGGSLRLSCAASGRTYDAMGWFRQAPGKEREFVAAISGSGDDTYYADSVKGRFTISRDNSKNTMYLQMNSLRPEDTAVYYCATRRGLYYVWDSNDYENWGQGTLVTVSS

SEQ ID NO: 784 - protein, 122 aa, Artificial Sequence
  Description of Artificial Sequence: Synthetic polypeptide
  Nanobody sequence
EVQLVESGGGLVQAGGSLRLSCAASGRTYDALGWLRQAPGKEREFVAAISGSGDDTYYADSVKGRFTISKDNAGITMYLQMNSLKPEDTAVYYCATRRGLYYVWDSNDYENWGQGTQVTVSS

SEQ ID NO: 785 - protein, 122 aa, Artificial Sequence
  Description of Artificial Sequence: Synthetic polypeptide
  Nanobody sequence
EVQLVESGGGLVQAGGSLRLSCAASGRTYDAMGWLRQAPGKEREFVAAISGSGDDTYYADSVKGRFTISKDNAGITLYLQMNSLKPEDTAVYYCATRRGLYYVWDSNDYENWGQGTQVTVSS

SEQ ID NO: 786 - protein, 122 aa, Artificial Sequence
  Description of Artificial Sequence: Synthetic polypeptide
  Nanobody sequence
EVQLVESGGGLVQAGGSLRLSCAASGRTYDAMGWLRQAPGKEREFVAAISGSGDDTYYADSVKGRFTISKDNAGITMYLQMNSLKPEDTAVYYCATRRGLYYVWDTNDYENWGQGTQVTVSS

SEQ ID NO: 787 - protein, 122 aa, Artificial Sequence
  Description of Artificial Sequence: Synthetic polypeptide
  Nanobody sequence
EVQLVESGGGLVQAGGSLRLSCAASGRTYDAMGWLRQAPGKEREFVAAISGSGDDTYYADSVKGRFTISKDNAGITMYLQMNSLKPEDTAVYYCATRRGLYYVWDANDYENWGQGTQVTVSS

SEQ ID NO: 788 - protein, 122 aa, Artificial Sequence
  Description of Artificial Sequence: Synthetic polypeptide
  Nanobody sequence
EVQLVESGGGLVQAGGSLRLSCAASGRTYDAVGWLRQAPGKEREFVAAISGSGDDTYYADSVKGRFTISKDNAGITMYLQMNSLKPEDTAVYYCATRRGLYYVWDSNDYENWGQGTQVTVSS

SEQ ID NO: 789 - protein, 122 aa, Artificial Sequence
  Description of Artificial Sequence: Synthetic polypeptide
  Nanobody sequence
EVQLVESGGGLVQAGGSLRLSCAASGRTYDAMGWLRQAPGKEREFVAAISGSGDDTYYADSVKGRFTISKDNAGITVYLQMNSLKPEDTAVYYCATRRGLYYVWDSNDYENWGQGTQVTVSS

SEQ ID NO: 790 - protein, 123 aa, Artificial Sequence
  Description of Artificial Sequence: Synthetic polypeptide
  Nanobody sequence
EVQLVESGGGLVQAGGSLRLSCAASGRTFSSYVVGWFRQAPGKEREFIGAISGSGGSIYYAVSEKDRFTISRDNGKNTLYLQMSSLKAEDTAVYYCTADQEFGYLRFGRSEYWGQGTQVTVSS

SEQ ID NO: 791 - protein, 123 aa, Artificial Sequence
  Description of Artificial Sequence: Synthetic polypeptide
  Nanobody sequence
EVQLVESGGGLVQAGGSLRLSCAASGRTFSSYVVGWFRQAPGKEREFIGAISGSGESIYYAVSEKDRFTISRDNGKNTLYLQMSSLKAEDTAVYYCTADQEFGYLRFGRSEYWGQGTQVTVSS

SEQ ID NO: 792 - protein, 123 aa, Artificial Sequence
  Description of Artificial Sequence: Synthetic polypeptide
  Nanobody sequence
EVQLVESGGGLVQAGGSLRLSCAASGRTFSSYVVGWFRQAPGKEREFIGAISGSGDTIYYAVSEKDRFTISRDNGKNTLYLQMSSLKAEDTAVYYCTADQEFGYLRFGRSEYWGQGTQVTVSS

SEQ ID NO: 793 - protein, 116 aa, Artificial Sequence
  Description of Artificial Sequence: Synthetic polypeptide
  Nanobody sequence
EVQLVESGGGSVQPGGSLRLSCAASGRANSINWFGWFRQTPGKEREFVAGIRWSDAYTEYANSVKGRFTISRDNSKNTVYLQMDSLRPEDTAVYYCVLDLSTVRYWGQGTLVTVSS

SEQ ID NO: 794 - protein, 116 aa, Artificial Sequence
  Description of Artificial Sequence: Synthetic polypeptide
  Nanobody sequence
EVQLVESGGGLVQPGDSLRLSCAASGRANSINWFGWFRQTPGKEREFVAGIRWSDAYTEYANSVKGRFTISRDNSKNTVDLQMDSLRPEDTAVYYCVLDLSTVRYWGQGTLVTVSS

SEQ ID NO: 795 - protein, 116 aa, Artificial Sequence
  Description of Artificial Sequence: Synthetic polypeptide
  Nanobody sequence
EVQLVESGGGSVQPGDSLRLSCAASGRANSINWFGWFRQAPGKEREFVAGIRWSDAYTEYANSVKGRFTISRDNSKNTVDLQMDSLRPEDTAVYYCVLDLSTVRYWGQGTLVTVSS

SEQ ID NO: 796 - protein, 116 aa, Artificial Sequence
  Description of Artificial Sequence: Synthetic polypeptide
  Nanobody sequence
EVQLVESGGGSVQPGDSLRLSCAASGRANSINWFGWFRQTPGKEREFVAGIRWSDAYTEYAASVKGRFTISRDNSKNTVDLQMDSLRPEDTAVYYCVLDLSTVRYWGQGTLVTVSS

SEQ ID NO: 797 - protein, 116 aa, Artificial Sequence
  Description of Artificial Sequence: Synthetic polypeptide
  Nanobody sequence
EVQLVESGGGLVQPGGSLRLSCAASGRANSINWFGWFRQAPGKEREFVAGIRWSDAYTEYAASVKGRFTISRDNSKNTVYLQMNSLRPEDTAVYYCVLDLSTVRYWGQGTLVTVSS

SEQ ID NO: 798 - protein, 116 aa, Artificial Sequence
  Description of Artificial Sequence: Synthetic polypeptide
  Nanobody sequence
EVQLVESGGGSVQPGDSLRLSCAASGRANSINWFGWFRQTPGKEREFVAGIRWSDAYTEYANSVKGRFTISRDNSKNTVDLQMNSLRPEDTAVYYCVLDLSTVRYWGQGTLVTVSS

SEQ ID NO: 799 - protein, 116 aa, Artificial Sequence
  Description of Artificial Sequence: Synthetic polypeptide
  Nanobody sequence
EVQLVESGGGSVQPGDSLRLSCAASGRANSINWFGWFRQAPGKEREFVAGIRWSDAYTEYANSVKGRFTISRDNSKNTVYLQMDSLRPEDTAVYYCVLDLSTVRYWGQGTLVTVSS

SEQ ID NO: 800 - protein, 116 aa, Artificial Sequence
  Description of Artificial Sequence: Synthetic polypeptide
  Nanobody sequence
EVQLVESGGGSVQPGGSLRLSCAASGRANSINWFGWFRQTPGKEREFVAGIRWSDAYTEYANSVKGRFTISRDNSKNTVDLQMDSLRPEDTAVYYCVLDLSTVRYWGQGTLVTVSS

SEQ ID NO: 801 - protein, 116 aa, Artificial Sequence
  Description of Artificial Sequence: Synthetic polypeptide
  Nanobody sequence
EVQLVESGGGSVQAGDSLRLSCAASGRAFSINWFGWFRQTPGKEREFVAGIRWSDAYTEYANSVKGRFTISRDNAKNTVDLQMDSLKPEDTAVYYCVLDLSTVRYWGQGTQVTVSS

SEQ ID NO: 802 - protein, 116 aa, Artificial Sequence
  Description of Artificial Sequence: Synthetic polypeptide
  Nanobody sequence
EVQLVESGGGSVQAGDSLRLSCAASGRASSINWFGWFRQTPGKEREFVAGIRWSDAYTEYANSVKGRFTISRDNAKNTVDLQMDSLKPEDTAVYYCVLDLSTVRYWGQGTQVTVSS

SEQ ID NO: 803 - protein, 116 aa, Artificial Sequence
  Description of Artificial Sequence: Synthetic polypeptide
  Nanobody sequence
EVQLVESGGGSVQAGDSLRLSCAASGRANTINWFGWFRQTPGKEREFVAGIRWSDAYTEYANSVKGRFTISRDNAKNTVDLQMDSLKPEDTAVYYCVLDLSTVRYWGQGTQVTVSS

SEQ ID NO: 804 - protein, 123 aa, Artificial Sequence
  Description of Artificial Sequence: Synthetic polypeptide
  Nanobody sequence
EVQLVESGGGLVQPGGSLRLSCAASGRTFSSYVVGWFRQAPGKEREFIGAISGSGDSIYYAVSEKDRFTISRDNSKNTLYLQMSSLRPEDTAVYYCTADQEFGYLRFGRSEYWGQGTLVTVSS

SEQ ID NO: 805 - protein, 123 aa, Artificial Sequence
  Description of Artificial Sequence: Synthetic polypeptide
  Nanobody sequence
EVQLVESGGGLVQPGGSLRLSCAASGRTFSSYVVGWFRQAPGKEREFIGAISGSGDSIYYAVSEKGRFTISRDNGKNTLYLQMNSLRAEDTAVYYCTADQEFGYLRFGRSEYWGQGTLVTVSS

SEQ ID NO: 806 - protein, 123 aa, Artificial Sequence
  Description of Artificial Sequence: Synthetic polypeptide
  Nanobody sequence
EVQLVESGGGLVQPGGSLRLSCAASGRTFSSYVVGWFRQAPGKEREFVGAISGSGDSIYYAVSEKDRFTISRDNSKNTLYLQMSSLRAEDTAVYYCTADQEFGYLRFGRSEYWGQGTLVTVSS

SEQ ID NO: 807 - protein, 116 aa, Artificial Sequence
  Description of Artificial Sequence: Synthetic polypeptide
  Nanobody sequence
DVQLVESGGGLVQPGGSLRLSCAASGRAFSINWFGWFRQAPGKEREFVAGIRWSDAYTEYADSVKGRFTISRDNSKNTVYLQMNSLRPEDTAVYYCVLDLSTVRYWGQGTLVTVSS

SEQ ID NO: 808 - protein, 123 aa, Artificial Sequence
  Description of Artificial Sequence: Synthetic polypeptide
  Nanobody sequence
EVQLVESGGGLVQPGGSLRLSCAASGRTFSSYVVGWFRQAPGKEREFVGAISGSGDSIYYAVSEKGRFTISRDNSKNTLYLQMNSLRPEDTAVYYCTADQEFGYLRFGRSEYWGQGTLVTVSS

SEQ ID NO: 809 - protein, 123 aa, Artificial Sequence
  Description of Artificial Sequence: Synthetic polypeptide
  Nanobody sequence
DVQLVESGGGLVQPGGSLRLSCAASGRTFSSYVVGWFRQAPGKEREFVGAISGSGESIYYAVSEKGRFTISRDNSKNTLYLQMNSLRPEDTAVYYCTADQEFGYLRFGRSEYWGQGTLVTVSS

SEQ ID NO: 810 - protein, 124 aa, Artificial Sequence
  Description of Artificial Sequence: Synthetic polypeptide
  Nanobody sequence
DVQLVESGGGLVQPGGSLRLSCTASGTIVNIHVMGWYRQAPGKQRELVALIFSGGSADYADSVKGRFTISRDNSKNTVYLQMNSLRPEDTAVYYCAAEIGYYSGGTYYSSEAHWGQGTLVTVSS

SEQ ID NO: 811 - protein, 124 aa, Artificial Sequence
  Description of Artificial Sequence: Synthetic polypeptide
  Nanobody sequence
DVQLVESGGGLVQPGGSLRLSCAASGTIVNIHVMGWYRQAPGKQRELVALIFSGGSADYADSVKGRFTISRDNSKNTVYLQMNSLRPEDTAVYYCAAEIGYYSGGTYYSSEAHWGQGTLVTVSS

SEQ ID NO: 812 - protein, 123 aa, Artificial Sequence
  Description of Artificial Sequence: Synthetic polypeptide
  Nanobody sequence
EVQLVESGGGLVQPGGSLRLSCAASGRTFSSYVVGWFRQAPGKEREFVGAISGSGESIYYAVSEKGRFTISRDNSKNTLYLQMNSLRPEDTAVYYCTADQEFGYLRFGRSEYWGQGTLVTVSS

SEQ ID NO: 813 - protein, 123 aa, Artificial Sequence
  Description of Artificial Sequence: Synthetic polypeptide
  Nanobody sequence
DVQLVESGGGLVQPGGSLRLSCAASGRTFSSYVVGWFRQAPGKEREFIGAISGSGESIYYAVSEKGRFTISRDNSKNTLYLQMNSLRPEDTAVYYCTADQEFGYLRFGRSEYWGQGTLVTVSS

SEQ ID NO: 814 - protein, 123 aa, Artificial Sequence
  Description of Artificial Sequence: Synthetic polypeptide
  Nanobody sequence
DVQLVESGGGLVQPGGSLRLSCAASGRTFSSYVVGWFRQAPGKEREFVGAISGSGDTIYYAVSEKGRFTISRDNSKNTLYLQMNSLRPEDTAVYYCTADQEFGYLRFGRSEYWGQGTLVTVSS

SEQ ID NO: 815 - protein, 123 aa, Artificial Sequence
  Description of Artificial Sequence: Synthetic polypeptide
  Nanobody sequence
DVQLVESGGGLVQPGGSLRLSCAASGRTFSSYVVGWFRQAPGKEREFIGAISGSGDTIYYAVSEKGRFTISRDNSKNTLYLQMNSLRPEDTAVYYCTADQEFGYLRFGRSEYWGQGTLVTVSS

SEQ ID NO: 816 - protein, 116 aa, Artificial Sequence
  Description of Artificial Sequence: Synthetic polypeptide
  Nanobody sequence
DVQLVESGGGLVQPGGSLRLSCAASGRASSINWFGWFRQAPGKEREFVAGIRWSDAYTEYADSVKGRFTISRDNSKNTVYLQMNSLRPEDTAVYYCVLDLSTVRYWGQGTLVTVSS

SEQ ID NO: 817 - protein, 116 aa, Artificial Sequence
  Description of Artificial Sequence: Synthetic polypeptide
  Nanobody sequence
DVQLVESGGGLVQPGGSLRLSCAASGRASSINWMGWFRQAPGKEREFVAGIRWSDAYTEYADSVKGRFTISRDNSKNTVYLQMNSLRPEDTAVYYCVLDLSTVRYWGQGTLVTVSS

SEQ ID NO: 818 - protein, 116 aa, Artificial Sequence
  Description of Artificial Sequence: Synthetic polypeptide
  Nanobody sequence
EVQLVESGGGLVQPGGSLRLSCAASGRASSINWMGWFRQAPGKEREFVAGIRWSDAYTEYADSVKGRFTISRDNSKNTVYLQMNSLRPEDTAVYYCVLDLSTVRYWGQGTLVTVSS

SEQ ID NO: 819 - protein, 122 aa, Artificial Sequence
  Description of Artificial Sequence: Synthetic polypeptide
  Nanobody sequence
EVQLVESGGGLVQPGGSLRLSCAASGRTYDAMGWLRQAPGKEREFVAAISGSGDDTYYADSVKGRFTISRDNSKNTLYLQMNSLRPEDTAVYYCATRRGLYYVWDANDYENWGQGTLVTVSS

SEQ ID NO: 820 - protein, 122 aa, Artificial Sequence
  Description of Artificial Sequence: Synthetic polypeptide
  Nanobody sequence
DVQLVESGGGLVQPGGSLRLSCAASGRTYDAMGWLRQAPGKEREFVAAISGSGDDTYYADSVKGRFTISRDNSKNTLYLQMNSLRPEDTAVYYCATRRGLYYVWDANDYENWGQGTLVTVSS

SEQ ID NO: 821 - protein, 122 aa, Artificial Sequence
  Description of Artificial Sequence: Synthetic polypeptide
  Nanobody sequence
EVQLVESGGGLVQPGGSLRLSCAASGRTYDALGWLRQAPGKEREFVAAISGSGDDTYYADSVKGRFTISRDNSKNTLYLQMNSLRPEDTAVYYCATRRGLYYVWDANDYENWGQGTLVTVSS

SEQ ID NO: 822 - protein, 122 aa, Artificial Sequence
  Description of Artificial Sequence: Synthetic polypeptide
  Nanobody sequence
DVQLVESGGGLVQPGGSLRLSCAASGRTYDALGWLRQAPGKEREFVAAISGSGDDTYYADSVKGRFTISRDNSKNTLYLQMNSLRPEDTAVYYCATRRGLYYVWDANDYENWGQGTLVTVSS

SEQ ID NO: 823 - protein, 124 aa, Artificial Sequence
  Description of Artificial Sequence: Synthetic polypeptide
  Nanobody sequence
DVQLVESGGGLVQPGGSLRLSCTASGTIVNIHVMGWYRQAPGKQRELVALIFSGGSADYADSVKGRFTISRDNAKNTVYLQMNSLRPEDTAVYYCAAEIGYYSGGTYYSSEAHWGQGTLVTVSS

SEQ ID NO: 824 - protein, 124 aa, Artificial Sequence
  Description of Artificial Sequence: Synthetic polypeptide
  Nanobody sequence
DVQLVESGGGLVQPGGSLRLSCAASGTIVNIHVMGWYRQAPGKQRELVALIFSGGSADYADSVKGRFTISRDNAKNTVYLQMNSLRPEDTAVYYCAAEIGYYSGGTYYSSEAHWGQGTLVTVSS

SEQ ID NO: 825 - protein, 116 aa, Artificial Sequence
  Description of Artificial Sequence: Synthetic polypeptide
  Nanobody sequence
DVQLVESGGGLVQPGGSLRLSCAASGRASSINWMGWFRQAPGKEREFVAGIRWSDAYTEYADSVKGRFTISRDNAKNTVYLQMNSLRPEDTAVYYCVLDLSTVRYWGQGTLVTVSS

SEQ ID NO: 826 - protein, 371 aa, Artificial Sequence
  Description of Artificial Sequence: Synthetic polypeptide
  Nanobody sequence
DVQLVESGGGLVQPGGSLRLSCAASGRTYDAMGWLRQAPGKEREFVAAISGSGDDTYYADSVKGRFTISRDNSKNTLYLQMNSLRPEDTAVYYCATRRGLYYVWDANDYENWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGRASSINWMGWFRQAPGKEREFVAGIRWSDAYTEYADSVKGRFTISRDNSKNTVYLQMNSLRPEDTAVYYCVLDLSTVRYWGQGTLVTVSS

SEQ ID NO: 827 - protein, 371 aa, Artificial Sequence
  Description of Artificial Sequence: Synthetic polypeptide
  Nanobody sequence
DVQLVESGGGLVQPGGSLRLSCAASGRASSINWMGWFRQAPGKEREFVAGIRWSDAYTEYADSVKGRFTISRDNSKNTVYLQMNSLRPEDTAVYYCVLDLSTVRYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGRTYDAMGWLRQAPGKEREFVAAISGSGDDTYYADSVKGRFTISRDNSKNTLYLQMNSLRPEDTAVYYCATRRGLYYVWDANDYENWGQGTLVTVSS

SEQ ID NO: 828 - protein, 377 aa, Artificial Sequence
  Description of Artificial Sequence: Synthetic polypeptide
  Nanobody sequence
DVQLVESGGGLVQPGGSLRLSCAASGRTYDAMGWLRQAPGKEREFVAAISGSGDDTYYADSVKGRFTISRDNSKNTLYLQMNSLRPEDTAVYYCATRRGLYYVWDANDYENWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGRTYDAMGWLRQAPGKEREFVAAISGSGDDTYYADSVKGRFTISRDNSKNTLYLQMNSLRPEDTAVYYCATRRGLYYVWDANDYENWGQGTLVTVSS

SEQ ID NO: 829 - protein, 365 aa, Artificial Sequence
  Description of Artificial Sequence: Synthetic polypeptide
  Nanobody sequence
DVQLVESGGGLVQPGGSLRLSCAASGRASSINWMGWFRQAPGKEREFVAGIRWSDAYTEYADSVKGRFTISRDNSKNTVYLQMNSLRPEDTAVYYCVLDLSTVRYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGRASSINWMGWFRQAPGKEREFVAGIRWSDAYTEYADSVKGRFTISRDNSKNTVYLQMNSLRPEDTAVYYCVLDLSTVRYWGQGTLVTVSS

SEQ ID NO: 830 - protein, 248 aa, Artificial Sequence
  Description of Artificial Sequence: Synthetic polypeptide
  Nanobody sequence
DVQLVESGGGLVQPGGSLRLSCTASGTIVNIHVMGWYRQAPGKQRELVALIFSGGSADYADSVKGRFTISRDNSKNTVYLQMNSLRPEDTAVYYCAAEIGYYSGGTYYSSEAHWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 831 - protein, 248 aa, Artificial Sequence
  Description of Artificial Sequence: Synthetic polypeptide
  Nanobody sequence
DVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCTASGTIVNIHVMGWYRQAPGKQRELVALIFSGGSADYADSVKGRFTISRDNSKNTVYLQMNSLRPEDTAVYYCAAEIGYYSGGTYYSSEAHWGQGTLVTVSS

SEQ ID NO: 832 - protein, 380 aa, Artificial Sequence
  Description of Artificial Sequence: Synthetic polypeptide
  Nanobody sequence
DVQLVESGGGLVQPGGSLRLSCTASGTIVNIHVMGWYRQAPGKQRELVALIFSGGSADYADSVKGRFTISRDNSKNTVYLQMNSLRPEDTAVYYCAAEIGYYSGGTYYSSEAHWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGRTFSSYVVGWFRQAPGKEREFIGAISGSGESIYYAVSEKGRFTISRDNSKNTLYLQMNSLRPEDTAVYYCTADQEFGYLRFGRSEYWGQGTLVTVSS

SEQ ID NO: 833 - protein, 380 aa, Artificial Sequence
  Description of Artificial Sequence: Synthetic polypeptide
  Nanobody sequence
DVQLVESGGGLVQPGGSLRLSCAASGRTFSSYVVGWFRQAPGKEREFIGAISGSGESIYYAVSEKGRFTISRDNSKNTLYLQMNSLRPEDTAVYYCTADQEFGYLRFGRSEYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCTASGTIVNIHVMGWYRQAPGKQRELVALIFSGGSADYADSVKGRFTISRDNSKNTVYLQMNSLRPEDTAVYYCAAEIGYYSGGTYYSSEAHWGQGTLVTVSS

SEQ ID NO: 834 - protein, 372 aa, Artificial Sequence
  Description of Artificial Sequence: Synthetic polypeptide
  Nanobody sequence
DVQLVESGGGLVQPGGSLRLSCAASGRTFSSYVVGWFRQAPGKEREFIGAISGSGESIYYAVSEKGRFTISRDNSKNTLYLQMNSLRPEDTAVYYCTADQEFGYLRFGRSEYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGRASSINWMGWFRQAPGKEREFVAGIRWSDAYTEYADSVKGRFTISRDNSKNTVYLQMNSLRPEDTAVYYCVLDLSTVRYWGQGTLVTVSS

SEQ ID NO: 835 - protein, 372 aa, Artificial Sequence
  Description of Artificial Sequence: Synthetic polypeptide
  Nanobody sequence
DVQLVESGGGLVQPGGSLRLSCAASGRASSINWMGWFRQAPGKEREFVAGIRWSDAYTEYADSVKGRFTISRDNSKNTVYLQMNSLRPEDTAVYYCVLDLSTVRYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGRTFSSYVVGWFRQAPGKEREFIGAISGSGESIYYAVSEKGRFTISRDNSKNTLYLQMNSLRPEDTAVYYCTADQEFGYLRFGRSEYWGQGTLVTVSS

SEQ ID NO: 836 - protein, 378 aa, Artificial Sequence
  Description of Artificial Sequence: Synthetic polypeptide
  Nanobody sequence
DVQLVESGGGLVQPGGSLRLSCAASGRTFSSYVVGWFRQAPGKEREFIGAISGSGESIYYAVSEKGRFTISRDNSKNTLYLQMNSLRPEDTAVYYCTADQEFGYLRFGRSEYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGRTYDAMGWLRQAPGKEREFVAAISGSGDDTYYADSVKGRFTISRDNSKNTLYLQMNSLRPEDTAVYYCATRRGLYYVWDANDYENWGQGTLVTVSS

SEQ ID NO: 837 - protein, 378 aa, Artificial Sequence
  Description of Artificial Sequence: Synthetic polypeptide
  Nanobody sequence
DVQLVESGGGLVQPGGSLRLSCAASGRTYDAMGWLRQAPGKEREFVAAISGSGDDTYYADSVKGRFTISRDNSKNTLYLQMNSLRPEDTAVYYCATRRGLYYVWDANDYENWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGRTFSSYVVGWFRQAPGKEREFIGAISGSGESIYYAVSEKGRFTISRDNSKNTLYLQMNSLRPEDTAVYYCTADQEFGYLRFGRSEYWGQGTLVTVSS

SEQ ID NO: 838 - protein, 401 aa, Artificial Sequence
  Description of Artificial Sequence: Synthetic polypeptide
  Nanobody sequence
DVQLVESGGGLVQPGGSLRLSCAASGRTFSSYVVGWFRQAPGKEREFIGAISGSGESIYYAVSEKGRFTISRDNSKNTLYLQMNSLRPEDTAVYYCTADQEFGYLRFGRSEYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGRTYDAMGWLRQAPGKEREFVAAISGSGDDTYYADSVKGRFTISRDNSKNTLYLQMNSLRPEDTAVYYCATRRGLYYVWDANDYENWGQGTLVTVSSGAAEQKLISEEDLNGAAHHHHHH

SEQ ID NO: 839 - protein, 132 aa, Homo sapiens
GITIPRNPGCPNSEDKNFPRTVMVNLNIHNRNTNTNPKRSSDYYNRSTSPWNLHRNEDPERYPSVIWEAKCRHLGCINADGNVDYHMNSVPIQQEILVLRREPPHCPNSFRLEKILVSVGCTCVTPIVHHVA

SEQ ID NO: 840 - protein, 133 aa, Homo sapiens [sequence omitted]

SEQ ID NO: 841 - protein, 115 aa, Artificial Sequence [sequence omitted]

SEQ ID NO: 842 - protein, 132 aa, Artificial Sequence
  Description of Artificial Sequence: Synthetic polypeptide
  Alb11 V2
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSAAAEQKLISEEDLNGAA

SEQ ID NO: 843 - protein, 15 aa, Artificial Sequence
  Description of Artificial Sequence: Synthetic peptide
RRGLYYVWDANDYEN

SEQ ID NO: 844 - protein, 4 aa, Artificial Sequence
  Description of Artificial Sequence: Synthetic peptide
KERE

SEQ ID NO: 845 - protein, 4 aa, Artificial Sequence
  Description of Artificial Sequence: Synthetic peptide
KQRE

SEQ ID NO: 846 - protein, 4 aa, Artificial Sequence
  Description of Artificial Sequence: Synthetic peptide
GLEW

SEQ ID NO: 847 - protein, 5 aa, Artificial Sequence
  Description of Artificial Sequence: Synthetic peptide
KEREL

SEQ ID NO: 848 - protein, 5 aa, Artificial Sequence
  Description of Artificial Sequence: Synthetic peptide
KEREF

SEQ ID NO: 849 - protein, 5 aa, Artificial Sequence
  Description of Artificial Sequence: Synthetic peptide
KQREL

SEQ ID NO: 850 - protein, 5 aa, Artificial Sequence
  Description of Artificial Sequence: Synthetic peptide
KQREF

SEQ ID NO: 851 - protein, 5 aa, Artificial Sequence
  Description of Artificial Sequence: Synthetic peptide
KEREG

SEQ ID NO: 852 - protein, 5 aa, Artificial Sequence
  Description of Artificial Sequence: Synthetic peptide
KQREW

SEQ ID NO: 853 - protein, 5 aa, Artificial Sequence
  Description of Artificial Sequence: Synthetic peptide
KQREG

SEQ ID NO: 854 - protein, 4 aa, Artificial Sequence
  Description of Artificial Sequence: Synthetic peptide
TERE

SEQ ID NO: 855 - protein, 5 aa, Artificial Sequence
  Description of Artificial Sequence: Synthetic peptide
TEREL

SEQ ID NO: 856 - protein, 4 aa, Artificial Sequence
  Description of Artificial Sequence: Synthetic peptide
TQRE

SEQ ID NO: 857 - protein, 5 aa, Artificial Sequence
  Description of Artificial Sequence: Synthetic peptide
TQREL

SEQ ID NO: 858 - protein, 4 aa, Artificial Sequence
  Description of Artificial Sequence: Synthetic peptide
KECE

SEQ ID NO: 859 - protein, 5 aa, Artificial Sequence
  Description of Artificial Sequence: Synthetic peptide
KECEL

SEQ ID NO: 860 - protein, 5 aa, Artificial Sequence
  Description of Artificial Sequence: Synthetic peptide
KECER

SEQ ID NO: 861 - protein, 4 aa, Artificial Sequence
  Description of Artificial Sequence: Synthetic peptide
KQCE

SEQ ID NO: 862 - protein, 5 aa, Artificial Sequence
  Description of Artificial Sequence: Synthetic peptide
KQCEL

SEQ ID NO: 863 - protein, 4 aa, Artificial Sequence
  Description of Artificial Sequence: Synthetic peptide
RERE

SEQ ID NO: 864 - protein, 5 aa, Artificial Sequence
  Description of Artificial Sequence: Synthetic peptide
REREG

SEQ ID NO: 865 - protein, 4 aa, Artificial Sequence
  Description of Artificial Sequence: Synthetic peptide
RQRE

SEQ ID NO: 866 - protein, 5 aa, Artificial Sequence
  Description of Artificial Sequence: Synthetic peptide
RQREL

SEQ ID NO: 867 - protein, 5 aa, Artificial Sequence
  Description of Artificial Sequence: Synthetic peptide
RQREF

SEQ ID NO: 868 - protein, 5 aa, Artificial Sequence
  Description of Artificial Sequence: Synthetic peptide
RQREW

SEQ ID NO: 869 - protein, 4 aa, Artificial Sequence
  Description of Artificial Sequence: Synthetic peptide
QERE

SEQ ID NO: 870 - protein, 5 aa, Artificial Sequence
  Description of Artificial Sequence: Synthetic peptide
QEREG

SEQ ID NO: 871 - protein, 4 aa, Artificial Sequence
  Description of Artificial Sequence: Synthetic peptide
QQRE

SEQ ID NO: 872 - protein, 5 aa, Artificial Sequence
  Description of Artificial Sequence: Synthetic peptide
QQREW

SEQ ID NO: 873 - protein, 5 aa, Artificial Sequence
  Description of Artificial Sequence: Synthetic peptide
QQREL

SEQ ID NO: 874 - protein, 5 aa, Artificial Sequence
  Description of Artificial Sequence: Synthetic peptide
QQREF

SEQ ID NO: 875 - protein, 4 aa, Artificial Sequence
  Description of Artificial Sequence: Synthetic peptide
KGRE

SEQ ID NO: 876 - protein, 5 aa, Artificial Sequence
  Description of Artificial Sequence: Synthetic peptide
KGREG

SEQ ID NO: 877 - protein, 4 aa, Artificial Sequence
  Description of Artificial Sequence: Synthetic peptide
KDRE

SEQ ID NO: 878 - protein, 5 aa, Artificial Sequence
  Description of Artificial Sequence: Synthetic peptide
KDREV

SEQ ID NO: 879 - protein, 5 aa, Artificial Sequence
  Description of Artificial Sequence: Synthetic peptide
DECKL

SEQ ID NO: 880 - protein, 5 aa, Artificial Sequence
  Description of Artificial Sequence: Synthetic peptide
NVCEL

SEQ ID NO: 881 - protein, 4 aa, Artificial Sequence
  Description of Artificial Sequence: Synthetic peptide
GVEW

SEQ ID NO: 882 - protein, 4 aa, Artificial Sequence
  Description of Artificial Sequence: Synthetic peptide
EPEW

SEQ ID NO: 883 - protein, 4 aa, Artificial Sequence
  Description of Artificial Sequence: Synthetic peptide
GLER

SEQ ID NO: 884 - protein, 4 aa, Artificial Sequence
  Description of Artificial Sequence: Synthetic peptide
DQEW

SEQ ID NO: 885 - protein, 4 aa, Artificial Sequence
  Description of Artificial Sequence: Synthetic peptide
DLEW

SEQ ID NO: 886 - protein, 4 aa, Artificial Sequence
  Description of Artificial Sequence: Synthetic peptide
GIEW

SEQ ID NO: 887 - protein, 4 aa, Artificial Sequence
  Description of Artificial Sequence: Synthetic peptide
ELEW

SEQ ID NO: 888 - protein, 4 aa, Artificial Sequence
  Description of Artificial Sequence: Synthetic peptide
GPEW

SEQ ID NO: 889 - protein, 4 aa, Artificial Sequence
  Description of Artificial Sequence: Synthetic peptide
EWLP

SEQ ID NO: 890 - protein, 4 aa, Artificial Sequence
  Description of Artificial Sequence: Synthetic peptide
GPER

SEQ ID NO: 891 - protein, 4 aa, Artificial Sequence
  Description of Artificial Sequence: Synthetic peptide
GLER

SEQ ID NO: 892 - protein, 4 aa, Artificial Sequence
  Description of Artificial Sequence: Synthetic peptide
ELEW

SEQ ID NO: 893 - protein, 15 aa, Artificial Sequence
  Description of Artificial Sequence: Synthetic peptide
GGGGSGGGGSGGGGS

SEQ ID NO: 894 - protein, 15 aa, Artificial Sequence
  Description of Artificial Sequence: Synthetic peptide
GGGSSGGGSSGGGSS

SEQ ID NO: 895 - protein, 6 aa, Artificial Sequence
  Description of Artificial Sequence: Synthetic 6xHis tag
HHHHHH

SEQ ID NO: 896 - protein, 8 aa, Artificial Sequence
  Description of Artificial Sequence: Synthetic peptide
DYKDDDDK

SEQ ID NO: 897 - protein, 15 aa, Artificial Sequence
  Description of Artificial Sequence: Synthetic peptide
EPKSSDKTHTCPPCP

SEQ ID NO: 898 - protein, 27 aa, Artificial Sequence
  Description of Artificial Sequence: Synthetic peptide
EPKTPKPQPQPQPQPNPTTESKCPKCP

SEQ ID NO: 899 - protein, 19 aa, Artificial Sequence
  Description of Artificial Sequence: Synthetic peptide
MEFGLSWLFLVAKIKGVQC

SEQ ID NO: 900 - protein, 19 aa, Artificial Sequence
  Description of Artificial Sequence: Synthetic peptide
MEWSWVFLFFLSVTTGVHS

The invention claimed is:

1. A polypeptide comprising at least one first immunoglobulin single variable domain (ISV) and at least one second ISV, wherein the first ISV comprises:

a) a CDR1 which is either (i) the amino acid sequence of SYVVG (SEQ ID NO: 222), or (ii) an amino acid sequence that has only one amino acid difference within the amino acid sequence of SYVVG (SEQ ID NO: 222);

b) a CDR2 which is either (i) the amino acid sequence of AISGSGDSIYYAVSEKD (SEQ ID NO: 364), or (ii) an amino acid sequence that has up to three amino acid differences within the amino acid sequence of AISGSGDSIYYAVSEKD (SEQ ID NO: 364); and c) a CDR3 which is either (i) the amino acid sequence of DQEFGYLRFGRSEY (SEQ ID NO: 506), or (ii) an amino acid sequence that has up to three amino acid differences within the amino acid sequence of DQEFGYLRFGRSEY (SEQ ID NO: 506);

and wherein the second ISV comprises:

a) a CDR1 which comprises the amino acid sequence of AMG (SEQ ID NO: 238);

b) a CDR2 which comprises either (i) the amino acid sequence of AISGSGDDTYYADSVKG (SEQ ID NO: 380), or (ii) an amino acid sequence that has up to three amino acid differences within the amino acid sequence of AISGSGDDTYYADSVKG (SEQ ID NO: 380); and c) a CDR3 which comprises either (i) the amino acid sequence of RRGLYYVWDSNDYEN (SEQ ID NO: 522), or (ii) an amino acid sequence that has up to three amino acid differences within the amino acid sequence of RRGLYYVWDSNDYEN (SEQ ID NO: 522), wherein the polypeptide specifically binds to human IL-17A (amino acids 1-132 of SEQ ID NO: 694), human IL-17F (amino acids 1-133 of SEQ ID NO: 695), and/or human IL-17 A/F.

2. The polypeptide according to claim 1, wherein each specific binding is characterized by a specific binding rate of dissociation ($k_{off}$ rate) between $10^{-4}$ $s^{-1}$ and $10^{-6}$ $s^{-1}$ as determined by surface plasmon resonance.

3. The polypeptide according to claim 1, wherein each specific binding occurs with a dissociation constant ($K_D$) of less than 1 nM, as determined by surface plasmon resonance.

4. The polypeptide according to claim 1, wherein the polypeptide binds to an IL-17F mutant with reduced affinity as compared to binding to the wildtype human IL-17F sequence, wherein the IL-17F mutant comprises one or more mutations of R47A, I86A, and N89A.

5. The polypeptide according to claim 1, wherein the polypeptide binds to an IL-17A mutant with reduced affinity as compared to binding to the wildtype human IL-17A, wherein the IL-17A mutant comprises one or more mutations of L74A, Y85A, and N88A.

6. The polypeptide according to claim 1, wherein the polypeptide comprises the amino acid sequence of SEQ ID NO: 836, or an amino acid sequence comprising SEQ ID NO: 836 with up to 6 amino acid substitutions.

7. The polypeptide according claim 1, wherein the polypeptide comprises the amino acid sequence of SEQ ID NO: 836, or an amino acid sequence comprising SEQ ID NO: 836 with up to 3 amino acid substitutions.

8. The polypeptide according to claim 1, wherein the polypeptide further comprises a light chain variable domain, a heavy chain variable domain and/or a single variable domain (VHH).

9. A pharmaceutical composition comprising the polypeptide according to claim 1 and a pharmaceutically acceptable excipient.

10. A method of treating systemic lupus erythematosis, rheumatoid arthritis, osteoarthritis, juvenile chronic arthritis, spondyloarthropathies, systemic sclerosis, idiopathic inflammatory myopathies, Sjögren's syndrome, systemic vasculitis, sarcoidosis, autoimmune hemolytic anemia, autoimmune thrombocytopenia, thyroiditis, diabetes mellitus, immune-mediated renal disease, demyelinating diseases of the central and peripheral nervous systems, multiple sclerosis, idiopathic demyelinating polyneuropathy, Guillain-Barre syndrome, chronic inflammatory demyelinating polyneuropathy, hepatobiliary diseases, infectious, autoimmune chronic active hepatitis, primary biliary cirrhosis, granulomatous hepatitis, sclerosing cholangitis, inflammatory bowel disease, gluten-sensitive enteropathy, Whipple's disease, autoimmune or immune-mediated skin diseases, bullous skin diseases, erythema multiforme, contact dermatitis, psoriasis, allergic diseases, asthma, allergic rhinitis, atopic dermatitis, food hypersensitivity, urticaria, eosinophilic pneumonia, idiopathic pulmonary fibrosis, hypersensitivity pneumonitis, transplantation associated diseases, graft rejection, or graft-versus-host-disease, the method comprising administering to a patient in need thereof an effective amount of the polypeptide according to claim 1.

11. A polypeptide comprising an immunoglobulin single variable domain (ISV) comprising at least three antibody complementarity determining regions (CDRs), wherein said polypeptide is able to compete with a second polypeptide for binding to human IL-17A (amino acids 1-132 of SEQ ID NO: 694), human IL-17F (amino acids 1-133 of SEQ ID NO: 695), and/or human IL-17 A/F, wherein the second polypeptide comprises:

(i) a first amino acid sequence comprising at least a first immunoglobulin single variable domain (ISV), said first ISV comprising the sequence of SEQ ID NO: 648 or a sequence comprising SEQ ID NO: 648 with up to 6 amino acid substitutions, wherein the first ISV specifically binds to the human IL-17F and to a heterodimer of the human IL-17A and the human IL-17F but does not specifically bind to the human IL-17A; and (ii) a second amino acid sequence comprising at least a second ISV, said second ISV comprising the sequence of SEQ ID NO: 664 or a sequence comprising SEQ ID NO: 664 with up to 6 amino acid substitutions, wherein the second ISV specifically binds to the human IL-17A, to the human IL-17F and to the heterodimer of the human IL-17A and the human IL-17F;

wherein the second polypeptide furthermore binds to an IL-17A mutant with reduced affinity as compared to binding to the wildtype human IL-17A, wherein the IL-17A mutant comprises one or more mutations of L74A, Y85A, and N88A.

12. The polypeptide of claim 11, wherein the polypeptide is a domain antibody.

13. A polypeptide comprising at least one first immunoglobulin single variable domain (ISV) and at least one second ISV, wherein:

(i) the first ISV comprises the sequence of SEQ ID NO: 648 or a sequence comprising SEQ ID NO: 648 with up to 6 amino acid substitutions; and (ii) the second ISV comprises the sequence of SEQ ID NO: 664 or a sequence comprising SEQ ID NO: 664 with up to 6 amino acid substitutions; and wherein (i) the first ISV specifically binds to human IL-17F (amino acids 1-133 of SEQ ID NO: 695) and to a heterodimer of human IL-17A (amino acids 1-132 of SEQ ID NO: 694) and the human IL-17F but does not specifically bind to the human IL-17A; and (ii) the second ISV specifically binds to the human IL-17A, to the human IL-17F and to a heterodimer of the human IL-17A and the human IL-17F.

* * * * *